US006723837B1

(12) United States Patent
Karunanandaa et al.

(10) Patent No.: US 6,723,837 B1
(45) Date of Patent: Apr. 20, 2004

(54) NUCLEIC ACID MOLECULE AND ENCODED PROTEIN ASSOCIATED WITH STEROL SYNTHESIS AND METABOLISM

(75) Inventors: Balasulojini Karunanandaa, Creve Coeur, MO (US); Jaehyuk Yu, Madison, WI (US); Ganesh Kishore, Creve Coeur, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 09/614,221

(22) Filed: Jul. 11, 2000

Related U.S. Application Data
(60) Provisional application No. 60/142,981, filed on Jul. 12, 1999.

(51) Int. Cl.[7] .......................... C12N 15/09; C12N 15/11; C12N 15/29
(52) U.S. Cl. ...................................... 536/23.1; 536/23.6
(58) Field of Search ................................ 800/278, 298, 800/306, 312, 313, 314, 320.1, 322; 536/23.1, 23.6; 435/6

(56) References Cited

PUBLICATIONS

Venter et al., "The Sequence of the Human Genome" *Science,* 291:1304–1351 (2001).
Woese et al., "Conservation of Primary Structure in 16S Ribosomal RNA" *Nature,* 254:83–85 (1975).
Annex to Form PCT/ISA/206 Communication Relating to the Results of the Partial International Search of PCT/US 00/18813.
Casper, Steven J., et al., "Expression of the green fluorescent protein–encoding gene from a tobacco mosaic virus–based vector", *Gene* 173, pp. 69–73, (1996).
Crowley, James H., et al., "A Mutation in a Purported Regulatory Gene Affects Control of Sterol Uptake in *Saccharomyces cerevisiae*", *Journal of Bacteriology,* vol. 180, No. 16, pp. 4177–4183, (1998).
Fang, Min, et al., "Kes1p shares homology with human oxysterol binding protein and participates in a novel regulatory pathway for yeast Golgi–derived transport vesicle biogenesis", *The Embo Journal,* vol. 15, No. 23, pp. 6447–6459, (1996).
Jiang, Bo, et al., "A New Family of Yeast Genes Implicated in Ergosterol Synthesis is Related to the Human Oxysterol Binding Protein", *Yeast,* vol. 10, pp. 341–353, (1994).
Lyne, M., et al., "S pombe KES1/HES1 homolog" Database accession No. 074178, (1998).
Nakamura, Y., "Structural analysis of *Arabidopsis thaliana* chromosome 5. XI." Database accession No. AB025604, (1999).
Newman, T., et al., "Genes Galore: A Summary of Methods for Accessing Results from Large–Scale Partial Sequencing of Anonymous Arabidopsis cDNA Clones", *Plant Physiology,* vol. 106, pp. 1241–1255, (1994).
Shoemaker, R., et al., "Public Soybean EST Project", Database accession No. AW596698, (2000).

*Primary Examiner*—David T. Fox
*Assistant Examiner*—Russell Kallis
(74) *Attorney, Agent, or Firm*—Thomas P. McBride; Arnold & Porter LLP

(57) ABSTRACT

This invention relates to the field of biotechnology, particularly as it pertains to a nucleic acid molecule encoding a protein associated with sterol and phytosterol synthesis and metabolism. The invention also relates to methods of detection using the nucleic acid molecule, or the encoded protein as a probe or in a microarray.

2 Claims, No Drawings

NUCLEIC ACID MOLECULE AND ENCODED PROTEIN ASSOCIATED WITH STEROL SYNTHESIS AND METABOLISM

This application claims the benefit of provisional application No. 60/142,981 filed on Jul. 12, 1999.

FIELD OF THE INVENTION

This invention relates to the field of biotechnology, particularly as it pertains to the production of sterols in a variety of host systems particularly plants. More specifically, the invention relates to nucleic acid molecules encoding proteins and fragments of proteins associated with sterol and phytosterol metabolism as well as the encoded proteins and fragments of proteins and antibodies capable of binding to them. The invention also relates to methods of using the nucleic acid molecules, fragments of the nucleic acid molecules, proteins, and fragments of proteins. The invention also relates to cells, organisms, particularly plants, or seeds, or progeny of plants, that have been manipulated to contain increased levels or overexpress at least one sterol or phytosterol compound.

BACKGROUND OF THE INVENTION

Sterols are a class of essential, natural compounds required by all eukaryotes to complete their life cycle. The types of sterols produced and predominantly present within each of the phylogenetic kingdoms varies. Plants produce a class of sterols called phytosterols. A phytosterol called sitosterol predominates. In animals, cholesterol is typically the major sterol while in fungi it is ergosterol.

Phytosterols from plants possess a wide spectrum of biological activities in animals and humans. Phytosterols are considered efficacious cholesterol-lowering agents (Pelletier et at., *Annals Nutrit. Metab.* 39:291–295 (1995). The entirety of which is herein incorporated by reference). Lower cholesterol levels are linked to a reduction in the risk to cardiovascular disease. Phytosterols can also block cholesterol absorption in the intestine, which would also lead to lower cholesterol levels. Thus, enhancing the levels of phytosterols in edible plants and seeds, or products derived from these plants and seeds, may lead to food products with increased nutritive or therapeutic value.

In one aspect, this invention provides these desirable plants and seeds as well as methods to produce them. Since, as will be discussed below, the genetic manipulation made possible by this invention involves families of related genes that cross phylogenetic boundaries, the effects are not limited to plants alone.

Biochemistry of Sterol Synthesis

A number of the important sterol biosynthetic enzymes, reactions, and intermediates have been described. Sterol synthesis uses acetyl CoA as the basic carbon building block. Multiple acetyl CoA molecules form the five-carbon isoprene units, hence the name isoprenoid pathway. Enzymatic combination of isoprene units leads to the thirty-carbon squalene molecule, which is the penultimate precursor to sterols.

Throughout plants, animals, and fungus, the reactions proceed as: acetyl CoA_HMGCoA, mevalonate, mevalonate 5 phosphate, mevalonate 5-pyrophosphate, isopentyl diphosphate, 5-pyrophosphatemevalonate, isopentyl pyrophosphate (PIP), dimethylallyl pyrophosphate (DMAPP), PIP+DMAPP, geranyl pyrophosphate+IPP, farnesyl pyrophosphate, 2 farnesyl pyrophosphate, squalene and squalene epoxide From squalene epoxide, the sterol biosynthesis pathway of plants diverges from that of animals and fungi. In plants, cycloartenol is produced next by cyclization of squalene epoxide. The plant pathway eventually leads to the synthesis of the predominant phytosterol, sitosterol.

Animals go on to produce lanosterol from squalene epoxide, eventually leading to cholesterol, which is the precursor to steroid hormones and bile acids, among other compounds, In fungi, lanosterol leads to the production of the predominant sterol, ergosterol.

An important regulatory control step within the pathway consists of the HMGCoA_Mevalonate step, catalyzed by HMGCoA reductase, and the condensation of 2 farnesyl pyrophosphates_squalene, catalyzed by squalene synthase. An early, reported rate-limiting step, in the pathway is the HMGCoA reductase-catalyzed reaction.

A number of studies have focused on the regulation of HMGCoA reductase, HMGCoA reductase (EC 1.1.1.34) catalyzes the reductive conversion of HMGCoA to mevalonic acid (MVA). This reaction is a reported controlling step in isoprenoid biosynthesis. The enzyme is regulated by feedback mechanisms and by a system of activation kinases and phosphatases (Gray, *Adv. Bot. Res.* 14: 25 (1987): Bach et al., *Lipids*, 26: 637 (1991): Stermer et al., *J. Lipid Res.*, 35: 1133 (1994), all of which are herein incorporated by reference in their entirety).

Another important regulation occurs at the squalene synthase step. Squalene synthase (EC 2.5.1.21) reductively condenses two molecules of FPP in the presence of $Mg^{2+}$ and NADPH to form squalene. The reaction involves a head-to-head condensation and forms a stable intermediate, presqualene diphosphate. The enzyme is subject to regulation similar to that of HMGCoA reductase and acts by balancing the incorporation of FPP into sterols and other compounds.

The sterol pathway of plants diverges from that in animals and fungi after squalene epoxide. In plants, the cyclization of squalene epoxide occurs next, under the regulated control of cycloartenol synthase (EC 5.4.99.8). The cyclization mechanism proceeds from the epoxy end into a chair-boat-chair-boat sequence that is mediated by a transient C-20 carbocationic intermediate. The reported rate-limiting step in plant sterol synthesis occurs in the next step, S-adenosyl-L-methionine:sterol C-24 methyl transferase (EC 2.1.1.41) ($SMT_I$) catalyzing the transfer of a methyl group from a cofactor, S-adenosyl-L-methionine, to the C-24 center of the sterol side chain. This is the first of two methyl transfer reactions. The second methyl transfer reaction occurs further down in the pathway and has been reported to be catalyzed by $SMT_{II}$. An isoform enzyme. $SMT_{II}$, catalyzes the conversion of 24-methylene lophenol to 24-ethylidene lophenol (Fonteneau et al., *Plant Sci Lett* 10:147–155(1977), the entirety of which is herein incorporated by reference). The presence of two distinct SMTs in plants were further confirmed by cloning cDNAs code the enzymes from Arabidopsis (Husselstein et al., *FEBS Lett* 381:87–92(1996), the entirety of which is herein incorporated by reference), soybean (Shi et al., *J Biol Chem* 271: 9384–9389(1996), the entirety of which is herein incorporated by reference), maize (Grebenok et al., *Plant Mol Biol* 34: 891–896(1997), the entirety of which is herein incorporated by reference) and tobacco (Bouvier-Nave et al., *Eur J Biochem* 246: 518–529 (1997): Bouvier-Nave et al., *Eur J Biochem* 256: 88–96 (1998), both of which are herein incorporated by reference in their entirety).

Later in the pathway, a sterol C-14 demethylase catalyzes the demethylation at C-14, removing the methyl group and creating a double bond. Interestingly, this enzyme also occurs in plants and fungi, but at a different point in the pathway. Sterol C14-demethylation is mediated by a cytochrome P-450 complex. A large family of enzymes utilize the cytochrome P-450 complex. There is, in addition, a family of cytochrome P450 complexes. For example, sterol C-22 desaturase (EC 2.7.3.9) catalyzes the formation of the double bond at C-22 on the side chain. The C-22 desaturase in yeast, which is the final step in the biosynthesis of ergosterol, contains a cytochrome P450 that is distinct from the cytochrome P450 participating in the demethylation reaction. Additional cytochrome P450 enzymes participate in brassinosteroid synthesis (Bishop, *Plant Cell* 8:959–969 (1996), the entirety of which is herein incorporated by reference). Brassinosteroids are steroidal compounds with plant growth regulatory properties, including modulation of cell expansion and photomorphogenesis (Artecal, *Plant Hormones, Physiology, Biochemistry and Molecular Biology* ed. Davies, Kluwer Academic Publishers, Dordrecht, 66 (1995), Yakota, *Trends in Plant Science* 2:137–143 (1997), both of which are herein incorporated by reference in their entirety.

One class of proteins, oxysterol-binding proteins, have been reported in humans and yeast (Jiang et al., *Yeast* 10: 341–353 (1994), the entirety of which is herein incorporated by reference). These proteins have been reported to modulate ergosterol levels in yeast (Jiang et al., *Yeast* 10: 341–353 (1994)). In particular, Jiang et al., reported three genes KES1, HES1 and OSH1, which encode proteins containing an oxysterol-binding region.

Enzyme Inhibitors and Modulators

Self-regulatory and feedback regulatory mechanisms of some of the sterol synthesis enzymes provide opportunities to effect sterol metabolism. For example, the introduction of the feedback inhibitor molecule inhibits enzyme action while the removal of that molecule up-regulates the enzyme. In certain circumstances, non-wild type enzymes can effect normal regulation. These organisms can be generated, for example, by traditional genetic crosses, mutation treatments and through molecular genetics. One example is the over-expression of plant HMGCoA reductase in transgenic plants resulting in a 6–10 fold increase in the total sterol levels (for example, transgenic tobacco plants overproducing phytosterols in Schaller et al., *Plant Physiol.* 109: 761 (1995), the entirety of which is herein incorporated by reference).

A number of compounds have been identified that, at least partially, exert their effects on sterol synthesis. For example, mevinolinic acid and lovastatin are competitive inhibitors of HMGCoA reductase and zaragonic acid is a competitive inhibitor of squalene synthase (Alberts et al., *Proc. Natl. Acad. Sci.* (*U.S.A.*) 77:3957–61 (1993); Bergstrom et al., *Proc. Natl. Acad. Sci.* (*U.S.A.*) 90:80–84 (1980), both of which are herein incorporated by reference). Many fungicides and insecticides act by inhibiting enzymes, such as those noted above or the C-14 demethylase enzyme (*Sterol Biosynthesis inhibitors and Anti-feeding Compounds*, Kato et al., Springer-Verlag, New York (1986); *Sterol biosynthesis inhibitors: pharmaceutical and agrochemical aspects*, eds. Berg and Plempel, Ellis Horwood, Chichester, England (1988), both of which are herein incorporated by reference in this entirety).

However, the use of these compounds can have toxic effects that preclude their use in products destined for animal or human consumption. Furthermore, the increase or decrease in sterol levels possible using these compounds is limited. Typically, the changes in levels occur over a wide spectrum of the pathway. New and more effective methods for manipulating sterol synthesis are desired.

The present invention provides a gene, Hes1, involved in plant phytosterol production. Expression of HES1 (protein) in organisms such as plants can increase phytosterol biosynthesis. The present invention also provides transgenic organisms expressing a HES1 protein, which can enhance food and feed sources.

SUMMARY OF THE INVENTION

The present invention includes a substantially purified nucleic acid molecule that encodes a protein comprising the amino acid sequence of SEQ ID NO: 622.

The present invention includes a substantially purified nucleic acid molecule that specifically hybridizes to a nucleic acid sequence of SEQ ID NO: 1 or its complement, wherein the nucleic acid molecule encodes a protein comprising the amino acid sequence of SEQ ID NO: 622.

The present invention includes a substantially purified nucleic acid molecule that encodes a protein comprising the amino acid sequence of SEQ ID NO: 623.

The present invention includes a substantially purified nucleic acid molecule that specifically hybridizes to a nucleic acid sequence of SEQ ID NO: 2 or its complement, wherein the nucleic acid molecule encodes a protein comprising the amino acid sequence of SEQ ID NO: 623.

The present invention includes a substantially purified nucleic acid molecule that encodes a protein comprising the amino acid sequence of SEQ ID NO: 624.

The present invention includes a substantially purified nucleic acid molecule that specifically hybridizes to a nucleic acid sequence of SEQ ID NO: 3 or its complement, wherein the nucleic acid molecule encodes a protein comprising the amino acid sequence of SEQ ID NO: 624.

The present invention includes a substantially purified nucleic acid molecule that encodes a protein comprising the amino acid sequence of SEQ ID NO: 625.

The present invention includes a substantially purified nucleic acid molecule that specifically hybridizes to a nucleic acid sequence of SEQ ID NO: 4 or its complement, wherein the nucleic acid molecule encodes a protein comprising the amino acid sequence of SEQ ID NO: 625.

The present invention includes a substantially purified nucleic acid molecule comprising a nucleic acid sequence which encodes a plant HES1 protein.

The present invention includes an antibody capable of specifically binding a protein comprising the amino acid sequence of SEQ ID NO: 622.

The present invention includes an antibody capable of specifically binding a protein comprising the amino acid sequence of SEQ ID NO: 623.

The present invention includes an antibody capable of specifically binding a protein comprising the amino acid sequence of SEQ ID NO: 624.

The present invention includes an antibody capable of specifically binding a protein comprising the amino acid sequence of SEQ ID NO: 625.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule comprises a nucleic acid sequence encoding a protein having an amino acid sequence selected from the group consisting of SEQ ID NO: 622 through SEQ ID NO: 626 or fragment thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a transcribed nucleic acid molecule with a transcribed strand and a non-transcribed strand, wherein the transcribed strand is complementary to a nucleic acid molecule comprising a nucleic acid sequence selected from the group consisting of SEQ ID NO: 1 through SEQ ID NO: 621 or fragment thereof; which is linked to (C) a 3' non-translated sequence that functions in plant cells to cause termination of transcription and addition of polyadenylated ribonucleotides to a 3' end of the mRNA molecule.

The present invention also provides a method for determining a level or pattern in a plant of a protein in a plant comprising: (A) incubating, under conditions permitting nucleic acid hybridization, a marker nucleic acid molecule, the marker nucleic acid molecule selected from the group of marker nucleic acid molecules which specifically hybridize to a nucleic acid molecule having the nucleic acid sequence of SEQ ID NO: 1 through SEQ ID NO: 621 or complements thereof, with a complementary nucleic acid molecule obtained from the plant cell or plant tissue. Wherein nucleic acid hybridization between the marker nucleic acid molecule and the complementary nucleic acid molecule obtained from the plant permits the detection of an mRNA for the enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the protein in the plant.

The present invention also provides a method for determining a level or pattern of a protein in a plant under evaluation which comprises assaying the concentration of a molecule, whose concentration is dependent upon the expression of a gene, the gene specifically hybridizes to a nucleic acid molecule having a nucleic acid sequence selected from the group consisting of SEQ ID NO: 1 through SEQ ID NO: 621 or complements thereof, in comparison to the concentration of that molecule present in a reference plant with a known level or pattern of the protein, wherein the assayed concentration of the molecule is compared to the assayed concentration of the molecule in the reference plant with the known level or pattern of the protein.

The present invention also provides a method for determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule having a nucleic acid sequence selected from the group of SEQ ID NO: 1 through SEQ ID NO: 621 or complements thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant: (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method of producing a plant containing an overexpressed protein comprising: (A) transforming the plant with a functional nucleic acid molecule, wherein the functional nucleic acid molecule comprises a promoter region, wherein the promoter region is linked to a structural region, wherein the structural region has a nucleic acid sequence selected from group consisting of SEQ ID NO: 1 through SEQ ID NO: 621, wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the protein; and (B) growing the transformed plant.

The present invention also provides a method of producing a plant containing an overexpressed protein comprising: (A) transforming the plant with a functional nucleic acid molecule, wherein the functional nucleic acid molecule comprises a promoter region, wherein the promoter region is linked to a structural region, wherein the structural region encodes a protein comprising an amino acid sequence selected from group consisting of SEQ ID NO: 622 through SEQ ID NO: 626, wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the protein: and (B) growing the transformed plant.

The present invention also provides a method of producing a plant containing reduced levels of a protein comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 621; wherein the structural region is linked to a 3' non-translated sequence that functions in the plant to cause termination of transcription and addition of polyadenylated ribonucleotides to a 3' end of a mRNA molecule and wherein the functional nucleic acid molecule results in co-suppression of the protein, and (B) growing the transformed plant.

The present invention also provides a method of producing a plant containing reduced levels of a protein comprising: (A) transforming the plant with a functional nucleic acid molecule, wherein the functional nucleic acid molecule comprises a promoter region, wherein the promoter region is linked to a structural region, wherein the structural region encodes a protein comprising an amino acid sequence selected from group consisting of SEQ ID NO: 622 through SEQ ID NO: 626; wherein the structural region is linked to a 3' non-translated sequence that functions in the plant to cause termination of transcription and addition of polyadenylated ribonucleotides to a 3' end of a mRNA molecule and wherein the functional nucleic acid molecule results in co-suppression of the protein; and (B) growing the transformed plant.

The present invention also provides a method for reducing expression of a protein in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein the transcribed strand is complementary to a nucleic acid molecule having a nucleic acid sequence selected from the group consisting of SEQ ID NO: 1 through SEQ ID NO: 621 or fragments thereof and the transcribed strand is complementary to an endogenous mRNA molecule; and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method for reducing expression of a protein in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein the transcribed strand is complementary to a nucleic acid molecule having a nucleic acid encodes a protein comprising an amino acid sequence selected from group consisting of SEQ ID NO: 622 through SEQ ID NO: 626 or fragments thereof and the transcribed strand is complementary to an endogenous mRNA molecule, and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method of determining an association between a polymorphism and a plant trait comprising: (A) hybridizing a nucleic acid molecule specific for the polymorphism to genetic material of a plant, wherein the nucleic acid molecule has a nucleic acid sequence selected from the group consisting of SEQ ID NO: 1 through SEQ ID NO: 621 or complements thereof or fragment of either; and (B) calculating the degree of association between the polymorphism and the plant trait.

The present invention also provides a method of isolating a nucleic acid that encodes a protein or fragment thereof comprising: (A) incubating under conditions permitting nucleic acid hybridization, a first nucleic acid molecule comprising a nucleic acid sequence selected from the group consisting of SEQ ID NO: 1 through SEQ ID NO: 621 or complements thereof or fragment of either with a complementary second nucleic acid molecule obtained from a plant: (B) permitting hybridization between the first nucleic acid molecule and the second nucleic acid molecule obtained from the plant; and (C) isolating the second nucleic acid molecule.

The present invention also provides a method for producing a protein or fragment thereof in an organism comprising introducing a vector comprising a nucleic acid of the present invention and expressing the protein or fragment.

DETAILED DESCRIPTION OF THE INVENTION

One skilled in the art can refer to general reference texts for detailed descriptions of known techniques discussed herein or equivalent techniques. These texts include *Current Protocols in Molecular Biology* Ausubel, et al., eds., John Wiley & Sons, N.Y. (1989), and supplements through September (1998), *Molecular Cloning, A Laboratory Manual* (Sambrook et al., 2nd Ed., Cold Spring Harbor Press, Cold Spring Harbor, N.Y. (1989), for example, each of which are specifically incorporated by reference in their entirety). These texts can also be referred to in making or using an aspect of the invention.

The agents of the invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic and thus involve the capacity of the agent to mediate a chemical reaction or response.

The term "substantially purified", as used herein, refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the invention may also be recombinant. As used herein, the term recombinant means any agent (e.g., DNA, peptide etc.), that is, or results, however indirect, from human manipulation of a nucleic acid molecule.

It is understood that the agents of the invention may be labeled with reagents that facilitate detection of the agent (e.g., fluorescent labels, Prober et al., *Science* 238:336–340 (1987): Albarella et al., EP 144914; chemical labels, Sheldon et al., U.S. Pat. No. 4,582,789; Albarella et al., U.S. Pat. No. 4,563,417; modified bases, Mivoshi et al., EP 119448, all of which are hereby incorporated by reference in their entirety). It is further understood that the invention provides recombinant bacterial, mammalian, microbial, archaebacterial, insect, fungal, and plant cells as well as viral constructs comprising the agents of the invention.

(a) Nucleic Acid Molecules

Agents of the invention include nucleic acid molecules and, more preferably, nucleic acid molecules of maize, soybean, canola, yeast, or Arabidopsis. In addition, a number of different plants can be the ultimate source of the nucleic acid molecules of the invention. An exemplary group of genotypes includes: B73 (Illinois Foundation Seeds, Champaign, Ill. U.S.A.); B73 x Mol7 (Illinois Foundation Seeds, Champaign, Ill. U.S.A.): DK604 (Dekalb Genetics, Dekalb, Ill. U.S.A.); H99 (Illinois Foundation Seeds, Champaign, Ill. U.S.A.); RX601 (Asgrow Seed Company, Des Moines, Iowa); and Mol7 (Illinois Foundation Seeds, Champaign, Ill. U.S.A.). And an exemplary group of soybean types includes: Asgrow 3244 (Asgrow Seed Company, Des Moines, Iowa); C1944 (United States Department of Agriculture (USDA) Soybean Germplasm Collection, Urbana, Ill. U.S.A.); Cristalina (USDA Soybean Germplasm Collection, Urbana, Ill. U.S.A.). FT108 (Monsoy, Brazil); Hartwig (USDA Soybean Germplasm Collection, Urbana, Ill. U.S.A.); BW211S Null (Tohoku University, Morioka, Japan), PI507354 (USDA Soybean Germplasm Collection, Urbana, Ill. U.S.A.); Asgrow A4922 (Asgrow Seed Company, Des Moines, Iowa U.S.A.); PI227687 (USDA Soybean Germplasm Collection, Urbana, Ill. U.S.A.): PI229358 (USDA Soybean Germplasm Collection, Urbana, Ill. U.S.A.); and Asgrow A3237 (Asgrow Seed Company, Des Moines, Iowa U.S.A.).

A particularly preferred embodiment of the nucleic acid molecules of the present invention are plant nucleic molecules that comprise a nucleic acid sequence which encodes an oxysterol-binding protein consensus sequence, for example, soybean HES1 (SEQ ID NOS: 622, 623 and 624), and maize HES1 (SEQ ID NO: 625).

Another particularly preferred embodiment of the nucleic acid molecules of the present invention are yeast nucleic acid molecules that comprise a nucleic acid sequence which encodes an oxysterol-binding protein consensus sequence, for example yeast HES1 (SEQ ID NO: 626).

A particularly preferred embodiment of the nucleic acid molecules of the invention are nucleic acid molecules that encode a protein or fragment thereof where the protein or fragment thereof is selected from the group consisting of a HES1, HMGCoA reductase, squalene synthase, cycloartenol synthase, SMTI, SMTII and UPC2. In a more particularly preferred embodiment of the nucleic acid molecules of the present invention are nucleic acid molecules that encode a protein or fragment thereof where the protein or fragment thereof is selected from the group consisting of a fungal, more preferably a yeast HES1, a plant, more preferably a maize, soybean or Arabidopsis HES1, a plant, more preferably a rubber or an Arabidopsis HMGCoA reductase, a plant, more preferably an Arabidopsis squalene synthase, a plant, more preferably an Arabidopsis cycloartenol synthase, a plant, more preferably an Arabidopsis SMTI or SMTII and a fungus, more preferably a yeast UPC2.

In a preferred embodiment, the nucleic molecule encodes a HES1 protein, preferably a plant HES1 protein comprising an oxysterol-binding protein consensus sequence—E(K, Q) xSH (H, R)PPx (S, T, A, C, F)A. In a further preferred embodiment, the nucleic acid molecule encodes a HES1 protein comprising an amino acid sequence selected from the group consisting of SEQ ID NO: 622, SEQ ID NO: 623, SEQ ID NO: 624 and SEQ ID NO: 625. In a further preferred embodiment, the nucleic acid molecule molecules encodes a HES1 protein with a conservative amino acid substitution in an amino acid sequence selected from the group consisting of SEQ ID NO: 622, SEQ ID NO: 623, SEQ ID NO: 624 and SEQ ID NO: 625. In a further preferred embodiment, the nucleic acid molecule molecules encodes a HES1 protein with between 2 and 5 conservative amino acid substitutions in an amino acid sequence selected from the group consisting of SEQ ID NO: 622, SEQ ID NO: 623, SEQ ID NO: 624 and SEQ ID NO: 625. In a further preferred embodiment, the nucleic acid molecule molecules encodes a HES1 protein with between 5 and 10 conservative amino acid substitutions in an amino acid sequence selected from the group consisting of SEQ ID NO: 622, SEQ ID NO: 623, SEQ ID NO: 624 and SEQ ID NO: 625. In a further preferred embodiment, the nucleic acid molecule encodes a HES1 protein with more than 10 conservative amino acid substitutions in an amino acid sequence selected from the group consisting of SEQ ID NO: 622, SEQ ID NO: 623, SEQ ID NO: 624 and SEQ ID NO: 625.

In another preferred embodiment, the nucleic molecule encodes a HES1 protein, preferably a yeast HES1 protein comprising an oxysterol-binding protein consensus sequence—E(K, Q) xSH (H, R) PPx (S, T, A, C, F)A. In a further preferred embodiments the nucleic acid molecule encodes a HES1 protein comprising an amino acid sequence SEQ ID NO: 626. In a further preferred embodiment, the nucleic acid molecule molecules encodes a HES1 protein with a conservative amino acid substitution in amino acid sequence SEQ ID NO: 626. In a further preferred embodiment, the nucleic acid molecule molecules encodes a HES1 protein with between 2 and 5 conservative amino acid substitutions in an amino acid sequence SEQ ID NO: 626. In a further preferred embodiment, the nucleic acid molecule molecules encodes a HES1 protein with between 5 and 10 conservative amino acid substitutions in an amino acid sequence SEQ ID NO: 626. In a further preferred embodiment, the nucleic acid molecule encodes a HES1 protein with more than 10 conservative amino acid substitutions in an amino acid sequence SEQ ID NO: 626.

In an aspect of the present invention, one or more of the nucleic acid molecules of the present invention differ in nucleic acid sequence from those encoding a protein or fragment thereof in SEQ ID NO: 1 through SEQ ID NO: 621 due to the degeneracy in the genetic code in that they encode the same protein but differ in nucleic acid sequence. In another further aspect of the present invention, one or more of the nucleic acid molecules of the present invention differ in nucleic acid sequence from those encoding a protein or fragment thereof in SEQ ID NO: 1 through SEQ ID NO: 621 due to fact that the different nucleic acid sequence encodes a protein having one or more conservative amino acid residue. Examples of conservative substitutions arc set forth in Table 1. It is understood that codons capable of coding for such conservative substitutions are known in the art.

TABLE 1

| Original Residue | Conservative Substitutions |
| --- | --- |
| Ala | Ser |
| Arg | Lys |
| Asn | Gln; His |
| Asp | Glu |
| Cys | Ser; Ala |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In a further aspect of the present invention, one or more of the nucleic acid molecules of the present invention differ in nucleic acid sequence from those encoding a protein or fragment thereof set forth in SEQ ID NO: 1 through SEQ ID NO: 621 or fragment thereof due to the fact that one or more codons encoding an amino acid has been substituted for a codon that encodes a nonessential substitution of the amino acid originally encoded.

One subset of the nucleic acid molecules of the invention is fragment nucleic acids molecules. Fragment nucleic acid molecules may consist of significant portion(s) of, or indeed most of, the nucleic acid molecules of the invention, such as those specifically disclosed. Alternatively, the fragments may comprise smaller oligonucleotides (having from about 15 to about 400 nucleotide residues and more preferably, about 15 to about 30 nucleotide residues, or about 50 to about 100 nucleotide residues, or about 100 to about 200 nucleotide residues, or about 200 to about 400 nucleotide residues, or about 275 to about 350 nucleotide residues).

A fragment of one or more of the nucleic acid molecules of the invention may be a probe and specifically a PCR probe. A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (www-genome.wi.mit.edu/cgi-bin/primer/primer3.cgi), STSPipeline (www-genome.wi.mit.edu/cgi-bin/www-STS_Pipeline), or GeneUp (Pesole et al., *BioTechniques* 25:112–123 (1998)), for example, can be used to identify potential PCR primers.

As used herein, two nucleic acid molecules are said to be capable of specifically hybridizing to one another if the two molecules are capable of forming an anti-parallel, double-stranded nucleic acid structure.

A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Mollecular Cloning, A Laboratory Manual*, 2nd Ed., Cold Spring Harbor Press, Cold Spring Harbor, N.Y. (1989) and by Haymes et al. *Nucleic Acid Hybridization, A Practical Approach*, IRL Press, Washington, D.C. (1985). Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization are, for example, 6.0×sodium chloride/sodium citrate (SSC) at about 45° C., followed by a wash of 2.0×SSC at 20–25° C., are known to those skilled in the art or can be found in *Current Protocols in Molecular Biology*, John Wiley & Sons, N.Y. (1989), 6.3.1–6.3.6. For example, the salt concentration in the wash step can be selected from a low stringency of about 2.0×SSC at 50° C. to a high stringency of about 0.2×SSC at 65° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the invention will specifically hybridize to one or more of the nucleic acid molecules set forth in SEQ ID NO: 1 through SEQ ID NO: 621 or complements thereof or more preferably to a nucleic acid molecule having a nucleic acid sequence selected from the group consisting of SEQ ID NO: 1 through SEQ ID NO: 4, SEQ ID NO: 6 through SEQ ID NO: 29 or complements thereof under moderately stringent conditions, for example at about 2.0×SSC and about 65° C.

In a particularly preferred embodiment, a nucleic acid of the invention will include those nucleic acid molecules that specifically hybridize to one or more of the nucleic acid molecules set forth in SEQ ID NO: 1 through SEQ ID NO: 621 or complements thereof or more preferably to a nucleic acid molecule having a nucleic acid sequence selected from the group consisting of SEQ ID NO: 1 through SEQ ID NO: 4, SEQ ID NO: 6 through SEQ ID NO: 29 or complements thereof under high stringency conditions such as 0.2×SSC and about 65° C.

In one aspect of the invention, the nucleic acid molecules of the invention have one or more of the nucleic acid sequences set forth in SEQ ID NO: 1 through SEQ ID NO: 621 or complements thereof or fragment thereof or more preferably to a nucleic acid molecule having SEQ ID NO: 1 through SEQ ID NO: 4, SEQ ID NO: 6 through SEQ ID NO: 29 or complements thereof. In another aspect of the invention, one or more of the nucleic acid molecules of the invention share between about 100% and 70% sequence identity with one or more of the nucleic acid sequences set forth in SEQ ID NO: 1 through SEQ ID NO: 621 or complements thereof or more preferably to a nucleic acid molecule having a nucleic acid sequence selected from the group consisting of SEQ ID NO: 1 through SEQ ID NO: 4, SEQ ID NO: 6 through SEQ ID NO: 29 or complements thereof. In a further aspect of the invention, one or more of the nucleic acid molecules of the invention share between about 100% and 90% sequence identity with one or more of the nucleic acid sequences set forth in SEQ ID NO: 1 through SEQ ID NO: 621 or complements thereof or more preferably to a nucleic acid molecule having a nucleic acid sequence selected from the group consisting of SEQ ID NO: 1 through SEQ ID NO: 4, SEQ ID NO: 6 through SEQ ID NO: 29 or complements thereof. In a more preferred aspect of the invention, one or more of the nucleic acid molecules of the invention share between about 100% and 95% sequence identity with one or more of the nucleic acid sequences set forth in SEQ ID NO: 1 through SEQ ID NO: 621 or complements thereof or more preferably to a nucleic acid molecule having a nucleic acid sequence selected from the group consisting of SEQ ID NO: 1 through SEQ ID NO: 4, SEQ ID NO: 6 through SEQ ID NO: 29 or complements thereof. In an even more preferred aspect of the invention, one or more of the nucleic acid molecules of the invention share between about 100% and 99% sequence identity with one or more of the sequences set forth in SEQ ID NO: 1 through SEQ ID NO: 621 or complements thereof or more preferably to a nucleic acid molecule having a nucleic acid sequence selected from the group consisting of SEQ ID NO: 1 through SEQ ID NO: 4, SEQ ID NO: 6 through SEQ ID NO: 29, or complements thereof.

In a preferred embodiment the percent identity calculations are performed using the Megalign program of the LASERGENE bioinformatics computing suite (default parameters, DNASTAR Inc., Madison, Wis.).

In a preferred embodiment of the present invention, the nucleic acid molecule of the present invention encodes a protein or fragment thereof, where a protein exhibits a BLAST probability score of greater than IE-12, preferably a BLAST probability score of between about IE-30 and about IE-12, even more preferably a BLAST probability score of greater than IE-30 with its homologue.

In a preferred embodiment of the present invention, the nucleic molecule of the present invention encodes a protein or fragment thereof where a protein exhibits a BLAST score of greater than 120, preferably a BLAST score of between about 1450 and about 120, even more preferably a BLAST score of greater than 1450 with its homologue.

Nucleic acid molecules of the present invention can comprise sequences that encode a protein or fragment thereof. Such proteins or fragments thereof include homologous of known proteins in other organisms.

A nucleic acid molecule of the invention can also encode a homolog protein. As used herein, a homolog protein molecule or fragment thereof is a counterpart protein molecule or fragment thereof in a second species (e.g., maize HES1 is a homolog of Arabidopsis HES1). A homolog can also be generated by molecular evolution or DNA shuffling techniques, so that the molecule retains at least one functional or structure characteristic of the original protein (see, for example, U.S. Pat. No. 5,811,238).

Particularly preferred homologues are selected from the group consisting of alfalfa, Arabidopsis, barley, Brassica, broccoli, cabbage, citrus, cotton, garlic, oat, oilseed rape, onion, canola, flax, an ornamental plant, maize, peanut, pepper, potato, rice, rye, sorghum, soybean, strawberry, sugarcane, sugarbeet, tomato, wheat, poplar, pine, fir, eucalyptus, apple, lettuce, lentils, grape, banana, tea, turf grasses, sunflower, soybean, and Phaseolus. A particularly preferred group of homologues are crops harvested for seed oils, including but not limited to rapeseed (high erucic acid rape and canola), maize, soybean, safflower, sunflower, cotton, peanut, flax, oil palm and Cuphea.

In a preferred embodiment, nucleic acid molecules having SEQ ID NO: 1 through SEQ ID NO: 621 or complements and fragments of either can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference).

Agents of the invention include nucleic acid molecules that encode a substantially purified nucleic acid molecules encoding at least about a 10 amino acid region, more preferably a 20, 30, 40, or 50 amino acid region, of a protein selected from the group consisting of a fungal, more preferably a yeast HES1, a plant, more preferably a maize, soybean or Arabidopsis HES1, a plant, more preferably a rubber or an Arabidopsis HMGCoA reductase, a plant, more preferably an Arabidopsis squalene synthase, a plant, more preferably an Arabidopsis cycloartenol synthase, a plant, more preferably an Arabidopsis SMTI or SMTII and a fungus, more preferably a yeast UPC2.

(b) Protein and Peptide Molecules

A class of agents comprises one or more of the protein or fragments thereof or peptide molecules having as nucleic acid sequence selected from the group consisting of SEQ ID NO: 1 through SEQ ID NO: 621 or one or more of the protein or fragment thereof and peptide molecules encoded by other nucleic acid agents of the invention. A particular preferred class of proteins are those having an amino acid sequence selected from the group consisting of SEQ ID NO: 622 through SEQ ID NO: 625 or fragments thereof.

As used herein, the term "protein molecule" or "peptide molecule" includes any molecule that comprises five or more amino acids. It is well known in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, norvaline, ornithine, homocysteine, and homoserine.

One or more of the protein or fragment of peptide molecules may be produced via chemical synthesis, or more preferably, by expressing in a suitable bacterial or eukaryotic host. Suitable methods for expression are described by Sambrook et al., In: Molecular Cloning, A Laboratory Manual, 2nd Edition, Cold Spring Harbor Press, Cold Spring Harbor, N.Y. (1989), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecules of the invention are preferably produced via recombinant means.

Another class of agents comprise protein or peptide molecules or fragments or fusions thereof comprising SEQ ID NO: 622 through SEQ NO: 625 or fragment thereof or encoded by SEQ ID NO: 1 through SEQ ID NO: 621 in which conservative, nonessential or non-relevant amino acid residues have been added, replaced or deleted. Computerized means for designing modifications in protein structure are known in the art (Dahiyat and Mayo, Science 278:82–87 (1997), the entirety of which is herein incorporated by reference).

A particularly preferred embodiment of the nucleic acid molecules of the present invention are proteins comprising an amino acid sequence which corresponds to an oxysterol-protein binding consensus sequence.

In a preferred embodiment of the present invention, the nucleic molecule of the present invention encodes a protein or fragment thereof, where a protein exhibits a BLAST probability score of greater than 1E-12, preferably a BLAST probability score of between about 1E-30 and about 1E-12, even more preferably a BLAST probability score of greater than 1E-30 with its homologue.

In a preferred embodiment of the present invention, the nucleic molecule of the present invention encodes a protein or fragment thereof where a protein exhibits a BLAST score of greater than 120, preferably a BLAST score of between about 1450 and about 120, even more preferably a BLAST score of greater than 1450 with its homologue.

In another preferred embodiment of the present invention, the nucleic acid molecule encoding a protein or fragment thereof exhibits a % identity with its homologue of between about 25% and about 40%, more preferably of between about 40 and about 70%, even more preferably of between about 70% and about 90% and even more preferably between about 90% and 99%. In another preferred embodiment of the present invention, a protein or fragments thereof exhibits a % identity with its homologue of 100%.

In a preferred embodiment the percent identity calculations are performed using the Megalign program of the LASERGENE bioinformatics computing suite (default parameters, DNASTAR Inc., Madison, Wis.).

A protein of the invention can also be a homologue protein. As used herein, a homologue protein molecule or fragment thereof is a counterpart protein molecule or fragment thereof in a second species (e.g., maize HMGCoA reductase is a homologue of Arabidopsis HMGCoA reductase). A homologue can also be generated by molecular evolution or DNA shuffling techniques, so that the molecule retains at least one functional or structure characteristic of the original (see, for example, U.S. Pat. No. 5,811,238, the entirety of which is herein incorporated by reference).

Particularly preferred homologous are selected from the group consisting of alfalfa, Arabidopsis, barley, Brassica, broccoli, cabbage, citrus, cotton, garlic, oat, oilseed rape, onion, canola, flax, an ornamental plant, maize, peanut, pepper, potato, rice, rye, sorghum, soybean, strawberry, sugarcane, sugarbeet, tomato, wheat, poplar, pine, fir, eucalyptus, apple, lettuce, lentils, grape, banana, tea, turf grasses, sunflower, soybean, and Phaseolus. A particularly preferred group of homologues are those from oil plants such as cotton, canola and sunflower.

In a preferred embodiment, nucleic acid molecules having SEQ ID NO: 1 through SEQ ID NO: 621 or complements and fragments of either can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference).

Agents of the invention include proteins comprising at least about a 10 amino acid region, more preferably a 20, 30, 40, or 50 amino acid region, of a protein selected from the group consisting of a fungal, more preferably a yeast HES1, a plant, more preferably a maize, soybean or Arabidopsis HES1, a plant, more preferably a rubber or an Arabidopsis HMGCoA reductase, a plant, more preferably an Arabidopsis squalene synthase, a plant, more preferably an Arabidopsis cycloartenol synthase, a plant, more preferably an Arabidopsis SMTI or SMTII and a fungus, more preferably a yeast UPC2.

(c) Plant Constructs and Plant Transformants

One or more of the nucleic acid molecules of the invention may be used in plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. In a preferred embodiment the exogenous genetic material includes a nucleic acid molecule of the present invention, preferably a nucleic acid molecule having a sequence selected from the group consisting of SEQ ID NO: 1 through SEQ ID NO: 621 or complements thereof or fragments of either. Another preferred class of exogenous genetic material are nucleic acid molecules that encode a protein having an amino acid selected from the group consisting of SEQ ID NO: 622 through SEQ ID NO: 626 or fragments thereof.

Genetic material may be transferred into either monocotyledons and dicotyledons including, but not limited to maize, soybean, Arabidopsis, phaseolus, peanut, alfalfa, wheat, rice, oat, sorghum, rye, titordeum, millet, fescue, perennial ryegrass, sugarcane, cranberry, papaya, banana, banana, muskmelon, apple, cucumber, dendrobium, gladiolus, chrysanthemum, liliacea, cotton, eucalyptus, sunflower, canola, turfgrass, sugarbeet, coffee and dioscorea (Christou, In: *Particle Bombardment for Genetic Engineering of Plants*, Biotechnology Intelligence Unit, Academic Press, San Diego, Calif. (1996), the entirety of which is herein incorporated by reference). In a particular preferred embodiment, any seed-bearing plant may be employed as the target plant species for modification in accordance with this invention, including angiosperms, gymnosperms, monocotyledons, and dicotyledons. Plants of special interest are crops harvested for seed oils, including but not limited to rapeseed (high erucic acid rape and canola), maize, soybean, safflower, sunflower, cotton, peanut, flax, oil palm and Cuphea.

Transfer of a nucleic acid that encodes for a protein can result in overexpression of that protein in a transformed cell or transgenic plant. One or more of the proteins or fragments thereof encoded by nucleic acid molecules of the invention may be overexpressed in a transformed cell or transformed plant. Such overexpression may be the result of transient or stable transfer of the exogenous genetic material.

In another preferred aspect of the present invention, exogenous genetic material is a nucleic acid molecule that comprises a nucleic acid sequence which encodes a HES1 protein or fragment thereof, more preferably a yeast HES1 protein or fragment thereof, even more preferably a plant HES1 protein or fragment thereof.

In a preferred embodiment, expression or overexpression of a HES1 protein in a plant provides in that plant, relative to an untransformed plant with a similar genetic background, in increased level of phytosterols.

In a preferred embodiment, expression or overexpression of a HES1 protein in a plant provides in that plant, relative to an untransformed plant with a similar genetic background, an altered composition of phytosterols.

In another embodiment, overexpression of a HES1 protein in a plant provides in that plant, relative to an untransformed plant with a similar genetic background, an increased level of a HES1 protein in a plasmid.

In another preferred embodiment, overexpression of the HES1 protein in a transformed plant will result in a plant which as a food or feed constituent exhibits an increased ability to act as a cholesterol lowering agent relative to an untransformed plant with a similar genetic background.

In a preferred embodiment of the present invention, the protein or fragment thereof overexpressed in the transgenic plant is selected from the group consisting of a HES1, HMGCoA reductase, squalene synthase, cycloartenol synthase, SMTI, SMTII and UPC2. In a more particularly preferred embodiment of the present invention is a protein or fragment thereof, where the protein or fragment thereof is selected from the group consisting of a fungal, more preferably a yeast HES1, a plant, more preferably a maize, soybean or Arabidopsis HES1, a plant, more preferably a rubber or an Arabidopsis HMGCoA reductase, a plant, more preferably an Arabidopsis, squalene synthase, a plant, more preferably an Arabidopsis cycloartenol synthase, a plant, more preferably an Arabidopsis SMTI or SMTII and a plant, more preferably a yeast UPC2.

In another preferred embodiment of the present invention, the protein or fragment thereof overexpressed in the transgenic plant is selected from the group consisting a plant HES1, HMGCoA reductase, squalene synthase, cycloartenol synthase, SMTI, SMTII and yeast UPC2. In a further even more particularly preferred embodiment of the present invention the protein or fragment thereof is a plant HES1. In an additional even more particularly preferred embodiment of the present invention the protein or fragment thereof is a maize, soybean or Arabidopsis HES1.

In another preferred embodiment of the present invention, the protein or fragment thereof overexpressed in the transgenic plant is a HES1 protein, preferably a plant HES1 protein comprising an oxysterol-binding protein consensus sequence—E(K, Q) xSH (H, R) PPx (S, T, A, C, F)A. In another preferred embodiment of the present invention, the protein or fragment thereof overexpressed in the transgenic plant is a HES1 protein that comprises an amino acid sequence selected from the group consisting of SEQ ID NO: 622, SEQ ID NO: 623, SEQ ID NO: 624 and SEQ ID NO: 625. In another preferred embodiment of the present invention, the protein or fragment thereof overexpressed in the transgenic plant is a HES1 protein with a conservative amino acid substitution in an amino acid sequence selected from the group consisting of SEQ ID NO: 622, SEQ ID NO: 623, SEQ ID NO: 624 and SEQ ID NO: 625. In another preferred embodiment of the present invention, the protein or fragment thereof overexpressed in the transgenic plant is a HES1 protein with between 2 and 5 conservative amino acid substitutions in an amino acid sequence selected from the group consisting of SEQ ID NO: 622, SEQ ID NO: 623, SEQ ID NO: 624 and SEQ ID NO: 625. In another preferred embodiment of the present invention, the protein or fragment thereof overexpressed in the transgenic plant is a HES1 protein with between 5 and 10 conservative amino acid substitutions in an amino acid sequence selected from the group consisting of SEQ ID NO: 622, SEQ ID NO: 623, SEQ ID NO: 624 and SEQ ID NO: 625. In another preferred embodiment of the present invention, the protein or fragment thereof overexpressed in the transgenic plant is a HES1 protein with more than 10 conservative amino acid substitutions in an amino acid sequence selected from the group consisting of SEQ ID NO: 622, SEQ ID NO: 623, SEQ ID NO: 624 and SEQ ID NO: 625.

In another preferred embodiment or the present invention, the protein or fragment thereof overexpressed in the transgenic plant is a HES1 protein that comprises an amino acid sequence SEQ ID NO: 626. In another preferred embodiment of the present invention, the protein or fragment thereof overexpressed in the transgenic plant is a HES1 protein with a conservative amino acid substitution in an amino acid sequence SEQ ID NO: 626. In another preferred embodiment of the present invention, the protein or fragment thereof overexpressed in the transgenic plant is a HES1 protein with between 2 and 5 conservative amino acid substitutions in an amino acid sequence SEQ ID NO: 626. In another preferred embodiment of the present invention, the protein or fragment thereof overexpressed in the transgenic plant is a HES1 protein with between 5 and 10 conservative amino acid substitutions in an amino acid sequence SEQ ID NO: 625. In another preferred embodiment of the present invention, the protein or fragment thereof overexpressed in the transgenic plant is a HES1 protein with more than 10 conservative amino acid substitutions in an amino acid sequence SEQ ID NO: 626.

Exogenous genetic material may be transferred into a host cell by the use of a DNA vector or construct designed for such a purpose. Design of such a vector is generally within the skill of the art (See, *Plant Molecular Biology: A Laboratory Manual*, Clark (ed.), Springier, N.Y. (1997), the entirety of which is herein incorporated by reference).

A construct or vector may include a plant promoter to express the protein or protein fragment of choice. A number of promoters, which are active in plant cells, have been described in the literature. These include the nopaline synthase (NOS) promoter (Ebert et al., *Proc. Natl. Acad. Sci. (U.S.A.)* 84:5745–5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al. *Plant Mol. Biol.* 9:315–324 (1987), the entirety of which is herein incorporated by reference) and the CaMV 35S promoter (Odell et al., *Nature* 313:810–812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci. (U.S.A.)* 84:6624–6628 (1987), the entirety of which is herein incorporated by reference), the sucrose synthase promoter (Yang et al., *Proc. Natl. Acad. Sci. (U.S.A.)* 87:4144–4148 (1990), the entirety of which is herein incorporated by reference), the R gene complex promoter (Chandler et al., *The Plant Cell* 1:1175–1183 (1989), the entirety of which is herein incorporated by reference) and the chlorophyll a/b binding protein gene promoter, etc. These promoters have been used to create DNA constructs that have been expressed in plants: see, e.g., PCT publication WO 84/02913, herein incorporated by reference in its entirety. The CaMV 35S promoters are preferred for use in plants. Promoters known or found to cause transcription of DNA in plant cells can be used in the invention.

For the purpose of expression in source tissues of the plant, such as the leaf, seed, root or stem, it is preferred that the promoters utilized have relatively high expression in these specific tissues. Tissue-specific expression of a protein of the present invention is a particularly preferred embodiment. For this purpose, one may choose from a number of promoters for genes with tissue- or cell-specific or -enhanced expression. Examples of such promoters reported in the literature include the chloroplast glutamine synthetase GS2 promoter from pea (Edwards et ill., *Proc. Natl. Acad. Sci. (U.S.A.)* 87:3459–3463 (1990), herein incorporated by reference in its entirety), the chloroplast fructose-1,6-biphosphatase (FBPase) promoter from wheat (Lloyd et al., *Mol. Gen. Genet.* 225:209–216 (1991), herein incorporated by reference in its entirety), the nuclear photosynthetic ST-LS1 promoter from potato (Stockhaus et al., *EMBO J.* 8:2445–2451 (1989), herein incorporated by reference in its entirety), the serine/threonine kinase (PAL) promoter and the glucoamylase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773–778 (1994), herein incorporated by reference in its entirety), the promoter for the Cab-1 gene from wheat (Fejes et al., Plant Mol. Biol. 15:921–932 (1990), herein incorporated by reference in its entirety), the promoter for the CAB-1 gene from spinach (Lubberstedt et al., *Plant Physiol.* 104:997–1006 (1994), herein incorporated by reference in its entirety), the promoter for the cab1R gene from rice (Luan et al., *Plant Cell.* 4:971–981 (1992), the entirety of which is herein incorporated by reference), the pyruvate, orthophosphate dikinase (PPDK) promoter from maize (Matsuoka et al., *Proc. Natl. Acad. Sci. (U.S.A.)* 90: 9586–9590 (1993), herein incorporated by reference in its entirety), the promoter for the tobacco Lhcb1*2 gene (Cerdan et al., Plant Mol. Biol. 33:245–255 (1997), herein incorporated by reference in its entirety), the *Arabidopsis thaliana* SUC2 sucrose-H+ symporter promoter (Truernit et al., *Planta* 196:564–570 (1995), herein incorporated by reference in its entirety) and the promoter for the thylakoid membrane proteins from spinach (psaD, psaF, psaE, PC, FNR, atpC, atpD, cab, rbcS). Other promoters for the chlorophyll a/b-binding proteins may also be utilized in the invention, such as the promoters for LhcB gene and PsbP gene from white mustard (*Sinapis alba*; Kretsch et al., *Plant Mol. Biol.* 28:219–229 (1995), the entirety of which is herein incorporated by reference).

For the purpose of expression in sink tissues of the plant, such as the tuber of the potato plant, the fruit of tomato, or the seed of maize, wheat, rice and barley, it is preferred that the promoters utilized in the invention have relatively high expression in these specific tissues. A number of promoters for genes with tuber-specific or -enhanced expression are known, including the class I patatin promoter (Bevan et al., *EMBO J.* 8:1899–1906 (1986); Jefferson et al., *Plant Mol. Biol.* 14:995–1006 (1990), both of which are herein incorporated by reference in their entirety), the promoter for the potato tuber ADPGPP genes, both the large and small subunits, the sucrose synthase promoter (Salanoubat and Belliard, *Gene* 60:47–56 (1987), Salanoubat and Belliard, *Gene* 84:181–185 (1989), both of which are incorporated by reference in their entirety), the promoter for the major tuber proteins including the 22 kd protein complexes and proteinase inhibitors (Hannapel, *Plant Physiol.* 101:703–704 (1993), herein incorporated by reference in its entirety), the promoter for the granule bound starch synthase gene (GBSS) (Visser et al., *Plant Mol. Biol.* 17:691–699 (1991), herein incorporated by reference in its entirety) and other class I and II patatins promoters (Koster-Topfer et al., *Mol Gen Genet.* 219:390–396 (1989); Mignery et al., *Gene,* 62:27–44 (1988), both of which are herein incorporated by reference in their entirety).

Other promoters can also be used to express a protein or fragment thereof in specific tissues, such as seeds or fruits. The promoter for β-conglycinin (Chen et al., *Dev. Genet.* 10: 112–122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29:1015–1026 (1982), herein incorporated by reference in its entirety) and the promoters from these clones, including the 15 kD, 16 kD, 19 kD, 22 kD, 27 kD and γ genes. could also be used. Other promoters known to function, for example, in maize include the promoters for the following genes: waxy, Brittle, Shrunken 2, Branching enzymes I and II, starch synthases, debranching enzymes, oleosins, glutelins and sucrose synthases. A particularly preferred promoter for maize endosperm expression is the promoter for the glutelin gene from rice, more particularly the Osgt-1 promoter (Zheng et al., *Mol. Cell Biol.* 13:5829–5842 (1993), herein incorporated by reference in its entirety). Examples of promoters suitable for expression in wheat include those promoters for the ADPglucose pyrosynthase (ADPGPP) subunits, the granule bound and other starch synthase, the branching and debranching enzymes, the embryogenesis-abundant proteins, the gliadins and the clutenins. Examples of such promoters in rice include those promoters for the ADPGPP subunits, the granule bound and other starch synthase, the branching enzymes, the debranching enzymes, sucrose synthases and the glutelins. A particularly preferred promoter is the promoter for rice glutelin, Osgt-1. Examples of such promoters for barley include those for the ADPGPP subunits, the granule bound and other starch synthase, the branching enzymes, the debranching enzymes, sucrose synthases, the hordeins, the embryo globulins and the aleurone specific proteins.

Root specific promoters may also be used. An example of such a promoter is the promoter for the acid chitinase gene (Samac et al., *Plant Mol. Biol.* 25:587–596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci. (U.S.A.)* 86:7890–7894 (1989), herein incorporated by reference in its entirety). Other root cell specific promoters include those reported by Conkling et al. (Conkling et al., *Plant Physiol.* 93:1203–1211 (1990), the entirety of which is herein incorporated by reference).

Additional promoters that may be utilized are described, for example, in U.S. Pat. Nos. 5,378,619; 5,391,725; 5,428, 147; 5,447,858; 5,608,144; 5,608,144; 5,614,399; 5,633, 441; 5,633,435; and 4,633,436, all of which are herein incorporated in their entirety. In addition, a tissue specific enhancer may be used (Fromm et al., *The Plant Cell* 1:977–984 (1989), the entirety of which is herein incorporated by reference).

Constructs or vectors may also include, with the coding region of interest, a nucleic acid sequence that acts, in whole or in part, to terminate transcription of that region. A number of such sequences have been isolated, including the Tr7 3' sequence and the NOS 3' sequence (Ingelbrecht et al., *The Plant Cell* 1:671–680 (1989), the entirety of which is herein incorporated by reference; Bevan et al., *Nucleic Acids Res.* 11:369–385 (1983), the entirety of which is herein incorporated by reference).

A vector or construct may also include regulatory elements. Examples of such include the Adh intron 1 (Callis et al., *Genes and Develop.* 1:1183–1200 (1987), the entirety of which is herein incorporated by reference), the sucrose synthase intron (Vasil et al., *Plant Physiol.* 91:1575–1579 (1989), the entirety of which is herein incorporated by reference) and the TMV omega element (Gallie et al., *The Plant Cell* 1:301–311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to: a neo gene (Potrykus et al., *Mol. Gen. Genet.* 199:183–188 (1985), the entirety of which is herein incorporated by reference), which codes for kanamycin resistance and can be selected for using kanamycin. G418, etc.: a bar gene which codes for bialaphos resistance: a mutant EPSP synthase gene (Hinchee et al., *Bio/Technology* 6:915–922 (1988), the entirety of which is herein incorporated by reference) which encodes glyphosate resistance: a nitrilase gene which confers resistance to bromoxynil (Stalker et al., *J. Biol. Chem.* 263:6310–6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500–12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' -non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., Plant Mol. Biol. 32:393–405 (1996), the entirety of which is herein incorporated by reference.

A vector or construct may also include a screenable marker. Screenable markers may be used to monitor expression. Exemplary screenable markers include: a β-glucuronidase or uidA gene (GUS) which encodes an enzyme for which various chromogenic substrates are known (Jefferson, *Plant Mol. Biol. Rep.* 5:387–405 (1987), the entirety of which is herein incorporated by reference; Jefferson et al., *EMBO J.* 6:3901–3907 (1987), the entirety of which is herein incorporated by reference): an R-locus gene, which encodes a product that regulates the production of anthocyanin pigments (red color) in plant tissues (Dellaporta et al., Stadler Symposium 11:263–282 (1988), the entirety of which is herein incorporated by reference); a β-lactamase gene (Sutcliffe et al., *Proc. Natl. Acad. Sci.* (*U.S.A.*) 75:3737–3741 (1978), the entirety of which is herein incorporated by reference), a gene which encodes an enzyme for which various chromogenic substrates are known (e.g., PADAC, a chromogenic cephalosporin): a luciferase gene (Ow et al., *Science* 234:856–859 (1986), the entirety of which is herein incorporated by reference); a xylE gene (Zukowsky et al., *Proc. Natl. Acad. Sci.* (*U.S.A.*) 80:1101–1105 (1983), the entirety of which is herein incorporated by reference) which encodes a catechol dioxygenase that can convert chromogenic catechols: an α-amylase gene (Ikatu et al., *Bio/Technol.* 8:241–242 (1990), the entirety of which is herein incorporated by reference): a tyrosinase gene (Katz et al., *J. Gen. Microbiol.* 129:2703–2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing transforming nucleic acid molecules into plant cells. Suitable methods are believed to include virtually any method by which nucleic acid molecules may be introduced into a cell, such as by Agrobacterium infection or direct delivery of nucleic acid molecules such as, for example, by PEG-mediated transformation, by electroporation or by acceleration of DNA coated particles, etc. (Potrykus. *Ann. Rev. Plant Physiol. Plant Mol. Biol.* 42:205–225 (1991), the entirety of which is herein incorporated by reference: Vasil, *Plant Mol. Biol.* 25:925–937 (1994), the entirety of which is herein incorporated by reference). For example, electroporation has been used to transform maize protoplasts (Fromm et al., *Nature* 312:791–793 (1986), the entirety of which is herein incorporated by reference).

Other vector systems suitable for introducing transforming DNA into a host plant cell include but are not limited to binary artificial chromosome (BIBAC) vectors (Hamilton et al., *Gene* 200:107–116 (1997), the entirety of which is herein incorporated by reference); and transfection with RNA viral vectors (Della-Cioppa et al., *Ann. N.Y. Acad. Sci.* (1996), 792 (Engineering Plants for Commercial Products and Applications), 57–61, the entirety of which is herein incorporated by reference). Additional vector systems also include plant selectable YAC vectors such as those described in Mullen et al., *Molecular Breeding* 4:449–457 (1988), the entirety of which is herein incorporated by reference).

Technology for introduction of DNA into cells is well known to those of skill in the art. Four general methods for delivering a gene into cells have been described: (1) chemical methods (Graham and van der Eb, *Virology* 54:536–539 (1973), the entirety of which is herein incorporated by reference); (2) physical methods such as microinjection (Capecchi, *Cell* 22:479–488 (1980), the entirety of which is herein incorporated by reference), electroporation (Wong and Neumann, *Biochem. Biophys. Res. Commun.* 107:584–587 (1982); Fromm et al., *Proc. Natl. Acad. Sci.* (*U.S.A.*) 82:5824–5828 (1985); U.S. Pat. No. 5,384,253, all of which are herein incorporated in their entirety); and the gene gun (Johnston and Tang, *Methods Cell Biol.* 43:353–365 (1994), the entirety of which is herein incorporated by reference); (3) viral vectors (Clapp, *Clin. Perinatol.* 20:155–168 (1993): Lu et al., *J. Exp. Med.* 178:2089–2096 (1993); Eglitis and Anderson, *Biotechniques* 6:608–614 (1988), all of which are herein incorporated in their entirety); and (4) receptor-mediated mechanisms (Curiel et al., *Hum. Gen. Ther.* 3:147–154 (1992), Wagner et al., *Proc. Natl. Acad. Sci.* (*U.S.A.*) 89:6099–6103 (1992), both of which are incorporated by reference in their entirety).

Acceleration methods that may be used include, for example, microprojectile bombardment and the like. One example of a method for delivering transforming nucleic acid molecules to plant cells is microprojectile bombardment. This method has been reviewed by Yang and Christou (eds.), *Particle Bombardment Technology for Gene Transfer,* Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum and the like.

A particular advantage of microprojectile bombardment, in addition to it being an effective means of reproducibly transforming monocots, is that neither the isolation of protoplasts (Cristou et al., *Plant Physiol.* 87:671–674 (1988), the entirety of which is herein incorporated by reference) nor the susceptibility of Agrobacterium infection are required. An illustrative embodiment of a method for delivering DNA into maize cells by acceleration is a biolistics α-particle delivery system, which can be used to propel particles coated with DNA through a screen, such as a stainless steel or Nytex screen, onto a filter surface covered with maize cells cultured in suspension. Gordon-Kamm et al., describes the basic procedure for coating tungsten particles with DNA (Gordon-Kamm et al., *Plant Cell* 2:603–618 (1990), the entirety of which is herein incorporated by reference). The screen disperses the tungsten nucleic acid particles so that they are not delivered to the recipient cells in large aggregates. A particle delivery system suitable for use with the invention is the helium acceleration PDS-1000/He gun is available from Bio-Rad Laboratories (Bio-Rad, Hercules, Calif.)(Sanford et al., *Technique* 3:3–16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. It desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/ microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment and also the nature of the transforming DNA, such as linearized DNA or intact supercoiled plasmids. It is believed that pre-bombardment manipulations are especially important for successful transformation of immature embryos.

In another alternative embodiment, plasmids can be stably transformed. Methods disclosed for plasmid transformation in higher plants include the particle gun delivery of DNA containing a selectable marker and targeting of the DNA to the plasmid genome through homologous recombination (Svab et al., *Proc. Natl. Acad. Sci. (U.S.A.)* 87:8526–8530 (1990); Svab and Maliga, *Proc. Natl. Acad. Sci. (U.S.A.)* 90:913–917 (1993); Staub and Maliga, *EMBO J.* 12:601–606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the ant in light of the present disclosure.

Agrobacterium-mediated transfer is a widely applicable system for introducing genes into plant cells because the DNA can be introduced into whole plant tissues, thereby bypassing the need for regeneration of an intact plant from a protoplast. The use of Agrobacterium-mediated plant integrating vectors to introduce DNA into plant cells is well known in the art. See, for example the methods described by Fraley et al., *Bio/Technology* 3:629–635 (1985) and Rogers et al., *Methods Enzymol.* 153:253–277 (1987), both of which are herein incorporated by reference in their entirety. Further, the integration of the Ti-DNA is a relatively precise process resulting in few rearrangements. The region of DNA to be transferred is defined by the border sequences and intervening DNA is usually inserted into the plant genome as described (Spielmann et al., *Mol. Gen. Genet.* 205:34 (1986), the entirety of which is herein incorporated by reference).

Modern Agrobacterium transformation vectors are capable of replication in *E. coli* as well as Agrobacterium, allowing for convenient manipulations as described (Klee et al., In: *Plant DNA Infectious Agents*, Hohn and Schell (eds.), Springer-Verlag, New York, pp. 179–203 (1985), the entirety of which is herein incorporated by reference). Moreover, technological advances in vectors for Agrobacterium-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Method Enzymol.* 153:253–277 (1987)). In addition, Agrobacterium containing both armed and disarmed Ti genes can be used for the transformations. In those plant strains where Agrobacterium-mediated transformation is efficient, it is the method of choice because of the facile and defined nature of the gene transfer. A transgenic plant formed using Agrobacterium transformation methods typically contains a single gene on one chromosome. Such transgenic plants can he referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation and combinations of these treatments (See, for example, Potrykus et al., *Mol. Gen. Genet.* 205:193–200 (1986); Lorz et al., *Mol. Gen. Genet.* 199:178 (1985): Fromm et al., *Nature* 319:791 (1986); Uchimiya et al., *Mol. Gen. Genet.* 204:204 (1986); Marcotte et al., *Nature* 335:454–457 (1988), all of which are herein incorporated by reference in their entirety).

Application of these systems to different plant strains depends upon the ability to regenerate that particular plant strain from protoplasts. Illustrative methods for the regeneration of cereals from protoplasts are described (Fujimura et al., *Plant Tissue Culture Letters* 2:74 (1985); Toriyama et al., *Theor Appl. Genet.* 205:34 (1986); Yamada et al., *Plant Cell Rep.* 4:85 (1986); Abdullah et al., *Biotechnolog.* 4:1087 (1986), all of which are herein incorporated by reference in their entirety).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology* 6:397 (1988), the entirety of which is herein incorporated by reference). In addition, "particle gun" or high-velocity microprojectile technology can be utilized (Vasil et al., *Bio/Technology* 10:667 (1992), the entirety of which is herein incorporated by reference).

Using the latter technology, DNA is carried through the cell wall and into the cytoplasm on the surface of small metal particles as described (Klein et al., *Nature* 328:70 (1987); Klein et al., *Proc. Natl. Acad. Sci. (U.S.A.)* 85:8502–8505 (1988); McCabe et al., *Bio/Technology* 6:923 (1988), all of which are herein incorporated by reference in their entirety). The metal particles penetrate through several layers of cells and thus allow the transformation of cells within tissue explants.

Other methods of cell transformation can also be used and include but are not limited to introduction of DNA into plants by direct DNA transfer into pollen (Hess et al., *Intern Rev. Cytol.* 107:367 (1987); Luo et al., *Plant Mol. Biol. Reporter* 6:165 (1988), all of which are herein incorporated by reference in their entirety), by direct injection of DNA into reproductive organs of a plant (Pena et al., *Nature* 325:274 (1987), the entirety of which is herein incorporated by reference), or by direct injection of DNA into the cells of immature embryos followed by the rehydration of desiccated embryos (Neuhaus et al., *Theor. Appl. Genet.* 75:30 (1987), the entirety of which is herein incorporated by reference).

The regeneration, development and cultivation of plants from single plant protoplast transformants or from various transformed explants is well known in the art (Weissbach and Weissbach, In: *Methods for Plant Molecular Biology*, Academic Press, San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are sell pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens* and obtaining transgenic plants have been published for cotton (U.S. Pat. Nos. 5,004,863; 5,159,135; 5,518,908, all of which are herein incorporated by reference in their entirety); soybean (U.S. Pat. Nos. 5,569,834; 5,416,011; McCabe et al., *Biotechnology* 6:923 (1988); Christou et al., *Plant Physiol.* 87:671–674 (1988): all of which are herein incorporated by reference in their entirety); Brassica (U.S. Pat. No. 5,463,174, the entirety of which is herein incorporated by reference); peanut (Cheng et al., *Plant Cell Rep.* 15:653–657 (1996), McKently et al., *Plant Cell Rep.* 14:699–703 (1995), all of which are herein incorporated by reference in their entirety); papaya; and pea (Grant et al., *Plant Cell Rep.* 15:254–258 (1995), the entirety of which is herein incorporated by reference).

Transformation of monocotyledons using electroporation, particle bombardment and Agrobacterium have also been reported. Transformation and plant regeneration have been achieved in asparagus (Bytebier et al., *Proc. Natl. Acad. Sci. (USA)* 84:5354 (1987), the entirety of which is herein incorporated by reference); barley (Wan and Lemaux, *Plant Physiol.* 104:37 (1994), the entirety of which is herein incorporated by reference); maize (Rhodes et al., *Science* 240:204 (1988); Gordon-Kamm et al., *Plant Cell* 2:603–618 (1990); Fromm et al., *Bio/Technology* 8:833 (1990); Koziel et al., *Bio/Technology* 11:194 (1993); Armstrong et al., *Crop Science* 35:550–557 (1995): all of which are herein incorporated by reference in their entirety); oat (Somers et al., Bio/Technology 10:1589 (1992), the entirety of which is herein incorporated by reference); orchard grass (Horn et al., *Plant Cell Rep.* 7:469 (1988), the entirety of which is herein incorporated by reference); rice (Toriyama et al., Theor Appl. Genet. 205:34 (1986); Part et al., *Plant Mol. Biol.* 32:1135–1148 (1996); Abedinia et al., *Aust. J. Plant Physiol.* 24:133–141 (1997); Zhang and Wu, *Theor. Appl. Genet.* 76:835 (1988); Zhang et al., *Plant Cell Rep.* 7:379 (1988); Battraw and Hall, *Plant Sci.* 86:191–202 (1992); Christou et al., *Bio/Technology* 9:957 (1991), all of which are herein incorporated by reference in their entirety); rye (De la Pena et al., *Nature* 325:274 (1987), the entirety of which is herein incorporated by reference); sugarcane (Bower and Birch, *Plant J.* 2:409 (1992), the entirety of which is herein incorporated by reference); tall fescue (Wang et al., *Bio/Technology* 10:691 (1992), the entirety of which is herein incorporated by reference) and wheat (Vasil et al., *Bio/Technology* 10:667 (1992), the entirety of which is herein incorporated by reference; U.S. Pat. No. 5,631,152, the entirety of which is herein incorporated by reference.)

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454–457 (1988), the entirety of which is herein incorporated by reference; Marcotte et al., *Plant Cell* 1:523–532 (1989), the entirety of which is herein incorporated by reference; McCarty et al., *Cell* 66:895–905 (1991), the entirety of which is herein incorporated by reference; Hattori et al., *Genes Dev.* 6:609–618 (1992), the entirety of which is herein incorporated by reference; Goff et al., *EMBO J.* 9:2517–2522 (1990), the entirety of which is herein incorporated by reference). Transient expression systems may be used to functionally dissect gene constructs (see generally, Mailga et al., *Methods in Plant Molecular Biology*, Cold Spring Harbor Press (1995)).

Any of the nucleic acid molecules of the invention may be introduced into a plant cell in a permanent or transient manner in combination with other genetic elements such as vectors, promoters, enhancers, etc. Further, any of the nucleic acid molecules of the invention may be introduced into a plant cell in a manner that allows for overexpression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2:279–289 (1990), the entirety of which is herein incorporated by reference; van der Krol et al., *Plant Cell* 2:291–299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465–475 (1992), the entirety of which is herein incorporated by reference) or with multiple copies of a nucleic acid molecule that is homologous to a nucleic acid sequence found with the cell (Mittlesten et al., *Mol. Gen. Genet.* 244:325–330 (1994), the entirety of which is herein incorporated by reference). Genes, even though different, linked to homologous promoters may result in the cosuppression of the linked genes (Vaucheret, *C.R. Acad. Sci. III* 316:1471–1483 (1993), the entirety of which is herein incorporated by reference).

This technique has, for example, been applied to generate white flowers from red petunia and tomatoes that do not ripen on the vine. Up to 50% of petunia transformants that contained a sense copy of the glucoamylase (CHS) gene produced white flowers or floral sectors, this was as a result of the post-transcriptional loss of mRNA encoding CHS (Flavell, *Proc. Natl. Acad. Sci. (U.S.A.)* 91:3490–3496 (1994), the entirety of which is herein incorporated by reference); van Blokland et al., *Plant J.* 6:861–877 (1994), the entirety of which is herein incorporated by reference). Cosuppression may require the coordinate transcription of the transgene and the endogenous gene and can be reset by a developmental control mechanism (Jorigensen, *Trends Biotechnol.* 8:340–344 (1990), the entirety of which is herein incorporated by reference; Meins and Kunz, In: *Gene Inactivation and Homologous Recombination in Plants*, Paszkowski (ed.), pp. 335–348, Kluwer Academic, Netherlands (1994), the entirety of which is herein incorporated by reference).

It is understood that one or more of the nucleic acids of the invention may be introduced into a plant cell and transcribed using an appropriate promoter wvith such transcription resulting in the cosuppression of an endogenous protein.

Antisense approaches are a way of preventing or reducing gene function by targeting the genetic material (Mol et al., *FEBS Lett.* 268:427–430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse' genetic approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., In: *Genetic Engineering*, Setlow (ed.), Vol. 11, New York: Plenum 49–63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569–597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155–184 (1990), the entirety of which is herein incorporated by reference). An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

It is understood that the activity of a protein in a plant cell may be reduced or depressed by growing a transformed plant cell containing a nucleic acid molecule of the present invention whose non-transcribed strand encodes a protein or fragment thereof.

Antibodies have been expressed in plants (Hiatt et al., *Nature* 342:76–78 (1989), the entirety of which is herein incorporated by reference: Conrad and Fielder, *Plant Mol. Biol.* 26:1023–1030 (1994), the entirety of which is herein incorporated by reference). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489–4496 (1997), the entirety of which is herein incorporated by reference; Marion-Poll, *Trends in Plant Science* 2:447–448 (1997), the entirety of which is herein incorporated by reference). For example, expressed anti-abscissic antibodies have been reported to result in a general perturbation of seed development (Philips et al., *EMBO J.* 16: 4489–4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313–1315 (1997), the entirety of which is herein incorporated by reference; Baca et al., *Ann. Rev. Biophys. Biomol. Struct.* 26:461–493 (1997), the entirety of which is herein incorporated by reference). The catalytic abilities of abzymes may be enhanced by site directed mutagenesis. Examples of abzymes are, for example, set forth in U.S. Pat. Nos.: 5,658,753: 5,632,990: 5,631,137; 5,602,015: 5,559,538: 5,576,174: 5,500,358: 5,318,897; 5,298,409: 5,258,289 and 5,194,585, all of which are herein incorporated in their entirety.

It is understood that any of the antibodies of the invention may be expressed in plants and that such expression can result in a physiolocgical effect. It is also understood that any of the expressed antibodies may be catalytic.

(d) Antibodies

One aspect of the invention concerns antibodies, single-chain antigen binding molecules, or other proteins that specifically bind to one or more of the protein or peptide molecules of the invention and their homologues, fusions or fragments. In a preferred embodiment, an antibody of the present invention binds to an amino acid selected from the group consisting of SEQ ID NO: 622 through 625. Such antibodies may be used to quantitatively or qualitatively detect the protein or peptide molecules of the invention. As used herein, an antibody or peptide is said to "specifically bind" to a protein or peptide molecule of the invention if such binding is not competitively inhibited by the presence of non-related molecules.

Nucleic acid molecules that encode all or part of the protein of the invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the invention may be expressed, via recombinant means, to yield proteins or peptides encoded by these nucleic acid molecules.

The antibodies that specifically bind proteins and protein fragments of the invention may be polyclonal or monoclonal and may comprise intact immunoglobulins, or antigen binding portions of immunoglobulins fragments (such as (F(ab'), F(ab')$_2$), or single-chain immunoglobulins producible, for example, via recombinant means. It is understood that practitioners are familiar with the standard resource materials which describe specific conditions and procedures for the construction, manipulation and isolation of antibodies (see, for example, Harlow and Lane, In: *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 μg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site and one subcutaneous site at the base of the tail. An additional i.v. injection of approximately 25 μg of antigen is preferably given in normal saline three weeks later. After approximately 11 days following the second injection, the mice may be bled and the blood screened for the presence of antiprotein or peptide antibodies. Preferably, a direct binding Enzyme-Linked Immunoassay (ELISA) is employed for this purpose.

More preferably, the mouse having the highest antibody titer is given a third i.v. injection of approximately 25 μg of the same protein or fragment. The splenic leukocytes from this animal may be recovered 3 days later and then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein or peptide of the invention, or conjugate of a protein or peptide of the invention, as immunogens. Thus, for example, a group of mice can be immunized using a fusion protein emulsified in Freund's complete adjuvant (e.g., approximately 50 μg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96 well microtiter plates and screened for hybridoma fusion cells by their capacity to row in culture medium supplemented with hypothanthine, aminopterin and thymidine for approximately 2–3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbor cells. Desirably, the fusion plates are screened several times since the rates of hybridoma growth vary. In a preferred sub-embodiment, a different antigenic form may be used to screen the hybridoma. Thus, for example, the splenocytes may be immunized with one immunogen, but the resulting hybridomas can be screened using a different immunogen. It is understood that any of the protein or peptide molecules of the invention may be used to raise antibodies.

As discussed below, such antibody molecules or their fragments may be used for diagnostic purposes. Where the antibodies are intended for diagnostic purposes, it may be desirable to derivatized them, for example with a ligand group (such as biolin) or a detectable marker group (such as a fluorescent group, a radioisotope or an enzyme).

The ability to produce antibodies that bind the protein or peptide molecules of the invention permits the identification of mimetic compounds derived from those molecules. These mimetic compounds may contain a fragment of the protein or peptide or merely a structurally similar region and nonetheless exhibits an ability to specifically bind to antibodies directed against that compound.

It is understood that any of the agents of the invention can be substantially purified and/or be biologically active and/or recombinant.

(e) Exemplary Uses

Nucleic acid molecules and fragments thereof of the invention may be employed to obtain other nucleic acid molecules from the same species (nucleic acid molecules from maize may be utilized to obtain other nucleic acid molecules from maize). Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen cDNA or genomic libraries. Methods for forming such libraries are well known in the art.

Nucleic acid molecules and fragments thereof of the invention may also be employed to obtain nucleic acid homologs. Such homologs include the nucleic acid molecule of other plants or other organisms (e.g., alfalfa, Arabidopsis, barley, Brassica, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, Phaseolus, etc.) including the nucleic acid molecules that encode, in whole or in part, protein homologs of other plant species or other organisms, sequences of genetic elements, such as promoters and transcriptional regulatory elements. Particularly preferred plants are selected from the group consisting of maize, canola, soybean, crambe, mustard, castor bean, peanut, sesame, cottonseed, linseed, safflower, oil palm, flax and sunflower.

Such molecules can be readily obtained by using the above-described nucleic acid molecules or fragments thereof to screen cDNA or genomic libraries obtained from such plant species. Methods for forming such libraries are well known in the art. Such homolog molecules may differ in their nucleotide sequences from those found in one or more of SEQ ID NOS: 1–4, 6–29 or complements thereof because complete complementarity is not needed for stable hybridization. The nucleic acid molecules of the invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci. (U.S.A.)* 83:4143–4146 (1986); Goodchild et al., *Proc. Natl. Acad. Sci. (U.S.A.)* 85:5507–5511 (1988); Wickstrom et al., *Proc. Natl. Acad. Sci. (U.S.A.)* 85:1028–1032 (1988); Holt et al., *Molec. Cell. Biol.* 8:963–973 (1988); Gerwirtz et al., *Science* 242:1303–1306 (1988); Anfossi et al., *Proc. Natl. Acad. Sci. (U.S.A.)* 86:3379–3383 (1989); Becker et al., *EMBO J.* 8:3685–3691 (1989)). Automated nucleic acid synthesizers may be employed for this purpose. In lieu of such synthesis, the disclosed nucleic acid molecules may be used to define a pair of primers that can be used with the polymerase chain reaction (Mullis et al., *Cold Spring Harbor Symp. Quant. Biol.* 51:263–273 (1986); Erlich et al., European Patent 50,424; European Patent 84,796; European Patent 258,017; European Patent 237,362; Mullis, European Patent 201,184; Mullis et al., U.S. Pat. No. 4,683,202; Erlich, U.S. Pat. No. 4,582,788; and Saiki et al., U.S. Pat. No. 4,683,194) to amplify and obtain any desired nucleic acid molecule or fragment.

Promoter sequences and other Genetic elements, including but not limited to transcriptional regulatory flanking sequences, associated with one or more of the disclosed nucleic acid sequences can also be obtained using the disclosed nucleic acid sequence provided herein. In one embodiment, such sequences are obtained by incubating, nucleic acid molecules of the present invention with members of genomic libraries and recovering clones that hybridize to such nucleic acid molecules thereof. In a second embodiment, methods of "chromosome walking," or inverse PCR may be used to obtain such sequences (Frohman et al., *Proc. Natl. Acad. Sci. (U.S.A.)* 85:8998–9002 (1988); Ohara et al., *Proc. Natl. Acad. Sci. (U.S.A.)* 86:5673–5677 (1989); Pang et al., *Biotechniques* 22:1046–1048 (1977); Huang et al., *Methods Mol. Biol.* 69:89–96 (1997); Huang et al., *Methods Mol. Biol.* 67:287–294 (1997); Benkel et al., *Genet. Anal.* 13:123–127 (1996); Harti et al., *Methods Mol. Biol.* 58:293–301 (1996)). The term "chromosome walking" means a process of extending a genetic map by successive hybridization steps.

The nucleic acid molecules of the invention may be used to isolate promoters of cell enhanced, cell specific, tissue enhanced, tissue specific, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et al., *Genome Analysis: Analyzing DNA*, 1, (1997), Cold Spring Harbor Laboratory Press, Cold Spring Harbor, N.Y.). Promoters obtained utilizing the nucleic acid molecules of the invention could also be modified to affect their control characteristics. Examples of such modifications would include but are not limited to enhancer sequences. Such genetic elements could be used to enhance gene expression of new and existing traits for crop improvement.

Another subset of the nucleic acid molecules of the invention includes nucleic acid molecules that are markers. The markers can be used in a number of conventional ways in the field of molecular genetics. Such markers include nucleic acid molecules SEQ ID NOs: 1–4, 6–29 or complements thereof or fragments of either that can act as markers and other nucleic acid molecules of the present invention that can act as markers.

Genetic markers of the invention include "dominant" or "codominant" markers. "Codominant markers" reveal the presence of two or more alleles (two per diploid individual) at a locus. "Dominant markers" reveal the presence of only a single allele per locus. The presence of the dominant marker phenotype (e.g., a hand of DNA) is an indication that one allele is in either the homozygous or heterozygous condition. The absence of the dominant marker phenotype (e.g., absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

The genomes of animals and plants naturally undergo spontaneous mutation in the course of their continuing evolution (Gusella, *Ann. Rev. Biochem.* 55:831–854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist and the polymorphism is thus said to be diallelic. In other cases, the species population may contain multiple alleles and the polymorphism is termed tri-allelic, etc. A single gene may have multiple different unrelated polymorphisms. For example, it may have a di-allelic polymorphism at one site and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., *FEBS Lett.* 307:113–115 (1992): Jones et al., *Eur. J. Haematol.* 39:144–147 (1987); Horn et al., PCT Patent Application WO91/14003; Jeffreys, European Patent Application 370, 719; Jeffreys, U.S. Pat. No. 5,175,082; Jeffreys et al., *Amer. J. Hum. Genet.* 39:11–24 (1986); Jeffreys et al., *Nature* 316:76–79 (1985); Gray et al., *Proc. R. Acad. Soc. Lond.* 24.:241–253 (1991); Moore et al., *Genomics*, 10:654–660 (1991); Jeffreys et al., *Anim. Genet.* 18:1–15 (1987); Hillel et al., *Anim. Genet.* 20:145–155 (1989); Hillel et al., *Genet.* 124:783–789 (1990)).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s) and more preferably within 100 kb of the polymorphism(s) and most preferably within 10 kb of the polymorphism(s) can be employed.

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, organisms that possess a variant sequence can he distinguished from those having the original sequence by restriction fragment analysis. Polymorphisms that can be identified in this manner are termed "restriction fragment length polymorphisms" ("RFLPs") (Glassberg, UK Patent Application 2135774; Skolnick et al., Cytogen. Cell Genet. 732:58–67 (1982); Botstein et al., *Anim. J. Hum. Genet.* 32:314–331 (1980); Fischer et al., (PCT Application WO90/13668; Uhlen, PCT Application WO90/11369).

Polymorphisms can also be identified by Single Strand Conformation Polymorphism (SSCP) analysis (Elles, *Methods in Molecular Medicine: Molecular Diagnosis of Genetic Diseases*, Humana Press (1996)); Orita et al., *Genomics* 5:874–879 (1989)). A number of protocols have been described for SSCP including, but not limited to, Lee et al., *Anal. Biochem.* 205:289–293 (1992); Suzuki et al., *Anal. Biochem.* 192:82–84 (1991): Lo et al., *Nucleic Acids Research* 20:1005–1009 (1992); Sarkar et al., *Geonmics* 13:441–443 (1992). It is understood that one or more of the nucleic acids of the invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA (Vos et al., *Nucleic Acids Res.* 23:4407–4414 (1995)). This method allows for the specific co-amplification of high numbers of restriction fragments, which can be visualized by PCR without knowledge of the nucleic acid sequence. It is understood that one or more of the nucleic acids of the invention may be utilized as markers or probes to detect polymorphisms by AFLP analysis or for fingerprinting RNA.

Polymorphisms may also be found using random amplified polymorphic DNA (RAPD) (Williams et al., *Nucl. Acid. Res.* 18:6531–6535 (1990)) and cleaveable amplified polymorphic sequences (CAPS) (Lyamichev et al., *Science* 260:778–783 (1993)). It is understood that one or more of the nucleic acid molecules of the invention, may be utilized as markers or probes to detect polymorphisms by RAPD or CAPS analysis.

Single Nucleotide Polymorphisms (SNPS) generally occur at greater frequency than other polymorphic markers and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a result of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314–331 (1980), the entirety of which is herein incorporated reference; Konieczny and Ausubel, Plaint J. 4:403–410 (1993), the entirety of which is herein incorporated by reference), enzymatic and chemical mismatch assays (Myers et al., *Nature* 313:495–498 (1985), the entirety of which is herein incorporated by reference), allele-specific PCR (Newton et al., *Nucl. Acids Res.* 17:2503–2516 (1989), the entirety of which is herein incorporated by reference; Wu et al., *Proc. Natl. Acad. Sci. USA* 86:2757–2760 (1989), the entirety of which is herein incorporated by reference), ligase chain reaction (Barany, *Proc. Natl. Acad. Sci. USA* 838:189–193 (1991), the entirety of which is herein incorporated by reference), single-strand conformation polymorphism analysis (Labrune et al., *Am. J. Hum. Genet.* 48: 1115–1120 (1991), the entirety of which is herein incorporated by reference), single base primer extension (Kuppuswamy et al., *Proc. Natl. Acad. Sci. USA* 88:1143–1147 (1991), Goelet U.S. Pat. No. 6,004,744; Goelet U.S. Pat. No. 5,888,819, all of which are herein incorporated by reference in their entirety), solid-phase ELISA-based oligonucleotide ligation assays (Nikiforov et al., *Nucl. Acids Res.* 22:4167–4175 (1994), dideoxy fingerprinting (Sarkar (et al., *Genomics* 13:441–443 (1992), the entirety of which is herein incorporated by reference), oligonucleotide fluorescence-quenching assays (Livak et al., *PCR Methods Appl.* 4:357–362 (1995a), the entirety of which is herein incorporated by reference). 5'-nuclease allele-specific hybridization TaqMan™ assay (Livak et al., *Nature Genet.* 9:341–342 (1995), the entirety of which is herein incorporated by reference), template-directed dye-terminator incorporation (TDI) assay (Chen and Kwok, *Nucl. Acids Res.* 25:347–353 (1997), the entirety of which is herein incorporated by reference), allele-specific molecular beacon assay (Tyagi et al., *Nature Biotech.* 16: 49–53 (1998), the entirety of which is herein incorporated by reference), PinPoint assay (Haff and Smirnov, *Genome Res.* 7: 378–388 (1997), the entirety of which is herein incorporated by reference), dCAPS analysis (Neff et al., *Plant J.* 14:387–392 (1998), the entirety of which is herein incorporated by reference), pyrosequencing (Ronaghi et al., *Analytical Biochemistry* 267:65–71 (1999); Ronaghi et al PCT application WO 98/13523; Nyren et al PCT application WO 98/28440, all of which are herein incorporated by reference in their entirety; http//www.pyrosequencing.com), using mass spectrometry, e.g., the Masscode™ system (Howbert et al WO 99/05319; Howber et al WO 97/27331, all of which are herein incorporated by reference in their entirety: http//www.rapigene.com; Becker et al PCT application WO 98/26095; Becker et al PCT application; WO 98/12355; Becker et al PCT application WO 97/33000; Monforte et al U.S. Pat. No. 5,965,363, all of which are herein incorporated by reference in their entirety), invasive cleavage of oligonucleotide probes (Lyamichev et al *Nature Biotechnology* 17:292–296, herein incorporated by reference in its entirety; http//www.twt.com), and using high density oligonucleotide arrays (Hacia et al *Nature Genetics* 22:164–167; herein incorporated by reference in its entirety; http//www.affymetrix.com).

Polymorphisms may also be detected using allele-specific oligonucleotides (ASO), which, can be for example, used in combination with hybridization based technology including southern, northern, and dot blot hybridizations, reverse dot blot hybridizations and hybridizations performed on microarray and related technology.

The stringency of hybridization for polymorphism detection is highly dependent upon a variety of factors, including length of the allele-specific oligonucleotide, sequence composition, degree of complementarity (i.e. presence or absence of base mismatches), concentration of salts and other factors such as formamide, and temperature. These factors are important both during the hybridization itself and during subsequent washes performed to remove target polynucleotide that is not specifically hybridized. In practice, the conditions of the final, most stringent wash are most critical. In addition, the amount of target polynucleotide that is able to hybridize to the allele-specific oligonucleotide is also governed by such factors as the concentration of both the ASO and the target polynucleotide, the presence and concentration of factors that act to "tie up" water molecules, so as to effectively concentrate the reagents (e.g., PEG, dextran, dextran sulfate, etc.), whether the nucleic acids are immobilized or in solution, and the duration of hybridization and washing steps.

Hybridizations are preferably performed below the melting temperature ($T_m$) of the ASO. The closer the hybridization and/or washing step is to the $T_m$, the higher the stringency. $T_m$ for an oligonucleotide may be approximated, for example, according to the following formula: $T_m = 81.5 + 16.6 \times (\log 10[Na+]) + 0.41 \times (\%G+C) - 675/n$; where [Na+] is the molar salt concentration of Na+ or any other suitable cation and n=number of bases in the oligonucleotide. Other formulas for approximating $T_m$ are available and are known to those of ordinary skill in the art.

Stringency is preferably adjusted so as to allow a given ASO to differentially hybridize to a target polynucleotide of the correct allele and a target polynucleotide of the incorrect allele. Preferably, there will be at least a two-fold differential between the signal produced by the ASO hybridizing to a target polynucleotide of the correct allele and the level of the signal produced by the ASO cross-hybridizing to a target polynucleotide of the incorrect allele (e.g., an ASO specific for a mutant allele cross-hybridizing to a wild-type allele). In more preferred embodiments of the present invention, there is at least a five-fold signal differential. In highly preferred embodiments of the present invention, there is at least an order of magnitude signal differential between the ASO hybridizing to a target polynucleotide of the correct allele and the level of the signal produced by the ASO cross-hybridizing to a target polynucleotide of the incorrect allele.

While certain methods for detecting polymorphisms are described herein, other detection methodologies may be utilized. For example, additional methodologies are known and set forth, in Birren et al., *Genome Analysis.* 4:135–186. *A Laboratory Manual, Mapping Genomes*, Cold Spring Harbor Laboratory Press, Cold Spring Harbor, N.Y. (1999); Maliga et al., *Methods in Plant Molecular Biology: A Laboratory Course Manual*, Cold Spring Harbor Laboratory Press, Cold Spring Harbor, N.Y. (1995); Paterson, *Biotechnology Intelligence Unit: Genome Mapping in Plants*, R. G. Landes Co., Georgetown, Tex., and Academic Press, San Diego, Calif. (1996); *The Maize Handbook*, Freeling and Walbot, eds., Springer-Verlag, New York, N.Y. (1994); *Methods in Molecular Medicine: Molecular Diagnosis of Genetic Diseases*, Elles, ed., Humana Press, Totowa, N.J. (1996); Clark, ed., *Plant Molecular Biology: A Laboratory Manual*, Clark, ed., Springer-Verlag, Berlin, Germany (1997), all of which are herein incorporated by reference in their entirety.

Requirements for marker-assisted selection in a plant breeding program arc: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185–199 (1989) and the interval mapping, based on maximum likelihood methods described by Lander and Botstein, *Genetics* 121:185–199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y.). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185–199 (1989) and further described by Arús and Moreno-González, *Plant Breeding*, Hayward et al., (eds.) Chapman & Hall, London, pp. 314–331 (1993).

In a preferred embodiment of the present invention the nucleic acid marker exhibits a LOD score of greater than 2.0, more preferably 2.5, even more preferably greater than 3.0 or 4.0 with the trait or phenotype of interest. In a preferred embodiment, the trait of interest is altered, preferably increased phytosterol levels or compositions.

Additional models can be used. Many modifications and alternative approaches to interval mapping have been reported, including the use non-parametric methods (Kruglyak and Lander, *Genetics* 139:1421–1428 (1995)). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116–124 (1994), Weber and Wricke, *Advances in Plant Breeding*, Blackwell, Berlin, 16 (1994)). Procedures combining interval mapping with regression analysis, whereby the phenotype is regressed onto a single putative QTL at a given marker interval and at the same time onto a number of markers that serve as cofactors, have been reported by Jansen and Stam, *Genetics* 1.6:1447–1455 (1994), and Zeng, *Genetics* 136:1457–1468 (1994). Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195–204 (1994), thereby improving the precision and efficiency of QTL mapping (Zeng, *Genetics* 136:1457–1468 (1994), herein incorporated by reference in its entirety). These models can be extended to multi-environment experiments to analyze genotype-environment interactions (Jansen et al., *Theo. Appl. Genet.* 91:33–37 (1995), herein incorporated by reference in its entirety).

It is understood that one or more of the nucleic acid molecules of the invention may be used as molecular markers. It is also understood that one or more of the protein molecules of the invention may be used as molecular markers.

In a preferred embodiment, the polymorphism is present and screened for in a mapping population, e.g., a collection of plants capable of being used with markers such as polymorphic markers to map genetic position of traits. The choice of appropriate mapping population often depends on the type of marker systems employed (Tanksley et al., *J. P. Gustafson and R. Appels* (eds.). Plenum Press, New York, pp. 157–173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted x exotic) and generally yield greatly reduced linkage distances. Wide crosses will usually provide segregating populations with a relatively large number of polymorphisms when compared to progeny in a narrow cross (adapted x adapted).

An $F_2$ population is the first generation of selfing (self-pollinating) after the hybrid seed is produced. Usually a single $F_1$ plant is selfed to generate a population segregating for all the genes in Mendelian (1:2:1) pattern. Maximum genetic information is obtained from a completely classified $F_2$ population using a codominant marker system (Mather, Measurement of Linkage in Heredity: Methuen and Co., (1938), the entirety of which is herein incorporated by reference). In the case of dominant markers, progeny tests (e.g., $F_3$ $BCF_2$) are required to identify the heterozygotes, in order to classify the population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e, about <10% recombination), dominant and co-dominant markers evaluated in RIL populations provide more information per individual than either marker type in backcross populations (Reiter, *Proc. Natl. Acad. Sci. (U.S.A.)* 89:1477–1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci. (U.S.A.)* 89:1477–1481 (1992), the entirety of which is herein incorporated by reference). Information obtained from backcross populations using either codominant or dominant markers is less than that obtained from $F_2$ populations because one, rather than two, recombinant gamete is sampled per plant. Backcross populations, however, are more informative (at low marker saturation) when compared to RILs as the distance between linked loci increases in RIL populations (i.e. about 0.15% recombination). Increased recombination can be beneficial for resolution of tight linkages, but may be undesirable in the construction of maps with low marker saturation.

Near-isogenic lines (NIL) (created by many backcrosses to produce a collection of individuals that is nearly identical in genetic composition except for the trait or genomic region under interrogation) can be used as a mapping population. In mapping with NILs, only a portion of the polymorphic loci is expected to map to a selected region.

Bulk segregant analysis (BSA) is a method developed for the rapid identification of linkage between markers and traits of interest (Michelmore et al., *Proc. Natl. Acad. Sci. U.S.A.* 88:9828–9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

In an aspect of the present invention, one or more of the nucleic molecules of the present invention are used to determine the level (i.e., the concentration of mRNA in a sample, etc.) in a plant (preferably maize, canola, soybean, crambe, mustard, castor bean, peanut, sesame, cottonseed, linseed, safflower, oil palm, flax or sunflower) or pattern (i.e., the kinetics of expression, rate of decomposition, stability profile, etc.) of the expression of a protein encoded in part or whole by one or more of the nucleic acid molecule of the present invention (collectively, the "Expression Response" of a cell or tissue).

As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made, rather, the Expression Response of a particular plant may be compared with previously obtained values of normal plants. As used herein, the phenotype of the organism is an of one or more characteristics of an organism (e.g. disease resistance, pest tolerance, environmental tolerance such as tolerance to abiotic stress, male sterility, quality improvement or yield etc.). A change in genotype or phenotype may be transient or permanent. Also as used herein, a tissue sample is any sample that comprises more than one cell. In a preferred aspect, a tissue sample comprises cells that share a common characteristic (e.g. derived from root, seed, flower, leaf, stem or pollen etc.).

In one aspect of the present invention, an evaluation can be conducted to determine whether a particular mRNA molecule is present. One or more of the nucleic acid molecules of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A number of methods can be used to compare the expression response between two or more samples of cells or tissue. These methods include hybridization assays, such as northerns. RNAse protection assays, and in situ hybridization. Alternatively, the methods include PCR-type assays. In a preferred method, the expression response is compared by hybridizing nucleic acids from the two or more samples to an array of nucleic acids. The array contains a plurality of suspected sequences known or suspected of being present in the cells or tissue of the samples.

An advantage of in situ hybridization over more conventional techniques for the detection of nucleic acids is that it allows an investigator to determine the precise spatial population (Angerer et al., *Dev. Biol.* 101:477–484 (1984): Angerer et al., *Dev. Biol.* 112:157–166 (1985); Dixon et al., *EMBO* 10:1317–1324 (1991)). In situ hybridization may be used to measure the steady-state level of RNA accumulation (Hardin et al., *J. Mol. Biol.* 202:417–431 (1989)). A number of protocols have been devised for in situ hybridization, each with tissue preparation. hybridization and washing conditions (Meyerowitz, *Plant Mol. Biol. Rep.* 5:242–250 (1987); Cox and Goldberg. In: *Plant Molecular Biology: A Practical Approach*, Shaw (ed.), pp. 1–35, IRL Press, Oxford (1988); Raikhel et al., *In situ RNA hybridization in plant tissues*, In: *Plant Molecular Biology Manual*, vol. B9:1–32, Kluwer Academic Publisher, Dordrecht, Belgium (1989)).

In situ hybridization also allows for the localization of proteins within a tissue or cell (Wilkinson, *In situ Hybridization*, Oxford University Press, Oxford (1992); Langdale, *In situ Hybridization* In: *The Maize Handbook*, Freeling and Walbot (eds.), pp. 165–179, Springer-Verlag, New York (1994)). It is understood that one or more of the molecules of the invention, preferably one or more of the nucleic acid molecules or fragments thereof of the invention or one or more of the antibodies of the invention may be utilized to detect the level or pattern of a protein or mRNA thereof by in situ hybridization.

Fluorescent in situ hybridization allows the localization of a particular DNA sequence along a chromosome, which is useful, among other uses, for gene mapping, following chromosomes in hybrid lines, or detecting chromosomes with translocations, transversions or deletions. In situ hybridization has been used to identify chromosomes in several plant species (Griffor et al., *Plant Mol. Biol.* 17:101–109 (1991); Gustafson et al., *Proc. Natl. Acad. Sci. (U.S.A.)* 87:1899–1902 (1990); Mukai and Gill, *Genome* 34:448–452 (1991); Schwarzacher and Heslop-Harrison, *Genome* 34:317–323 (1991); Wang et al., *Jpn. J. Genet.* 66:313–316 (1991); Parra and Windle, *Nature Genetics* 5:17–21 (1993)). It is understood that the nucleic acid molecules of the invention may be used as probes or markers to localize sequences along a chromosome.

Another method to localize the expression of a molecule is tissue printing. Tissue printing provides a way to screen, at the same time on the same membrane many tissue sections from different plants or different developmental stages (Yomo and Taylor, *Planta* 112:35–43 (1973); Harris and Chrispeels, *Plant Physiol.* 56:292–299 (1975); Cassab and Varner, *J. Cell. Biol.* 105:2581–2588 (1987); Spruce et al., *Phytochemistry* 26:2901–2903 (1987); Barres et al., *Neuron* 5:527–544 (1990); Reid and Pont-Lezica, *Tissue Printing: Tools for the Study of Anatomy, Histochemisty and Gene Expression*, Academic Press, New York, N.Y. (1992); Reid et al., *Plant Physiol.* 93:160–165 (1990); Ye et al., *Plant J.* 1:175–183 (1991)).

A microarray-based method for high-throughput monitoring of gene expression may be utilized to measure expression response. This 'chip'-based approach involves microarrays of nucleic acid molecules as gene-specific hybridization targets to quantitatively measure expression of the corresponding mRNA (Schena et al., *Science* 270:467–470

(1995), the entirety of which is herein incorporated by reference; http://cmgm.stanford.edu/pbrown/array.html; Shalon, Ph.D. Thesis, Stanford University (1996), the entirety of which is herein incorporated by reference). Hybridization to a microarray can be used to efficiently analyze the presence and/or amount of a number of nucleotide sequences simultaneously.

Several microarray methods have been described. One method compares the sequences to be analyzed by hybridization to a set of oligonucleotides representing all possible subsequences (Bains and Smith, *J. Theor. Biol.* 135:303–307 (1989), the entirety of which is herein incorporated by reference). A second method hybridizes the sample to an array of oligonucleotide or cDNA molecules. An array consisting of oligonucleotides complementary to subsequences of a target sequence can be used to determine the identity of a target sequence, measure its amount, and detect single nucleotide differences between the target and a reference sequence. Nucleic acid molecule microarrays may also be screened with protein molecules or fragments thereof to determine nucleic acid molecules that specifically bind protein molecules or fragments thereof.

The microarray approach may be used with polypeptide targets (U.S. Pat. Nos. 5,445,934; 5,143,854; 5,079,600; 4,923,901, all of which are herein incorporated by reference in their entirety). Essentially polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. (Fodor et al., *Science* 251:767–773 (1991), the entirety of which is herein incorporated by reference). It is understood that one or more of the nucleic acid molecules or protein or fragments thereof of the invention may be utilized in a microarray-based method.

In a preferred embodiment of the present invention microarrays may be prepared that comprise nucleic acid molecules where preferably at least 10%, preferably at least 25%, more preferably at least 50% and even more preferably at least 75%, 80%, 85%, 90% or 95% of the nucleic acid molecules located on that array are selected from the group of nucleic acid molecules that specifically hybridize to one or more nucleic acid molecule having a nucleic acid sequence selected from the group of SEQ ID NO: 1 through SEQ ID NO: 621 or complements thereof or fragments of either.

In another preferred embodiment of the present invention microarrays may be prepared that comprise nucleic acid molecules where preferably at least 10%, preferably at least 25%, more preferably at least 50% and even more preferably at least 75%, 80%, 85%, 90% or 95% of the nucleic acid molecules located on that array are selected from the group of nucleic acid molecules having a nucleic acid sequence selected from the group of SEQ ID NO: 1 through SEQ ID NO: 621 or complements thereof or fragments of either.

In a preferred embodiment of the present invention microarrays may be prepared that comprise nucleic acid molecules where such nucleic acid molecules encode at least one, preferably at least two, more preferably at least three, even more preferably at least four, five or six proteins or fragments thereof selected from the group consisting of HES1, HMGCoA reductase, squalene synthase, cycloartenol synthase, SMTII and UPC2. In even more preferred embodiment of the present invention microarrays may be prepared that comprise nucleic acid molecules where such nucleic acid molecules encode at least one, preferably at least two, more preferably at least three, even more preferably at least four, five or six proteins or fragments thereof selected from the group consisting of a fungal, more preferably a yeast HES 1, a plant, more preferably a maize, soybean or Arabidopsis HES1, a plant, more preferably a rubber or an Arabidopsis HMGCoA reductase, a plant, more preferably an Arabidopsis squalene synthase, a plant, more preferably an Arabidopsis cycloartenol synthase, a plant, more preferably an Arabidopsis SMTII and a fungus, more preferably an yeast UPC2.

Site directed mutagenesis may be utilized to modify nucleic acid sequences, particularly as it is a technique that allows one or more of the amino acids encoded by a nucleic acid molecule to be altered (e.g., a threonine to be replaced by a methionine). At least three basic methods for site directed mutagenesis can be employed. These are cassette mutagenesis (Wells et al., *Gene* 34:315–323 (1985), the entirety of which is herein incorporated by reference), primer extension (Gilliam et al., *Gene* 12:129–137 (1980), the entirety of which is herein incorporated by reference; Zoller and Smith, *Methods Enzymol.* 100:468–500 (1983), the entirety of which is herein incorporated by reference; Dalbadie-McFarland et al., *Proc. Natl. Acad. Sci. (U.S.A.)* 79:6409–6413 (1982), the entirety of which is herein incorporated by reference) and methods based upon PCR (Scharf et al., *Science* 233:1076–1078 (1986), the entirety of which is herein incorporated by reference; Higuchi et al., *Nucleic Acids Res.* 16:7351–7367 (1988), the entirety of which is herein incorporated by reference). Site directed mutagenesis approaches are also described in U.S. Pat. No. 5,811,238, European Patent 0 385 962, the entirety of which is herein incorporated by reference; European Patent 0 359 472, the entirety of which is herein incorporated by reference; and PCT Patent Application WO 93/07278, the entirety of which is herein incorporated by reference.

Site directed mutagenesis strategies have been applied to plants for both in vitro, as well as in vivo site directed mutagenesis (Lanz et al., *J. Biol. Chem.* 266:9971–9976 (1991), the entirety of which is herein incorporated by reference; Kovgan and Zhdanov, *Biotekhnologiya* 5:148–154, No. 207160n. Chemical Abstracts 110:225 (1989), the entirety of which is herein incorporated by reference; Ge et al., *Proc. Natl. Acad. Sci. (U.S.A.)* 86:4037–4041 (1989), the entirety of which is herein incorporated by reference; Zhu et al., *J. Biol. Chem.* 271:18494–18498 (1996), the entirety of which is herein incorporated by reference; Chu et al., *Biochemistry* 33:6150–6157 (1994), the entirety of which is herein incorporated by reference; Small et al., *EMBO J.* 11:1291–1296 (1992), the entirety of which is herein incorporated by reference: Cho et al., *Mol. Biotechnol.* 8:13–16 (1997), the entirety of which is herein incorporated by reference; Kita et al., *J. Biol. Chem.* 271:26529–26535 (1996), the entirety of which is herein incorporated by reference, Jin et al., *Mol. Microbiol.* 7:555–562 (1993), the entirety of which is herein incorporated by reference; Hatfield and Vierstra, *J. Biol. Chem.* 267:14799–14803 (1992), the entirety of which is herein incorporated by reference; Zhao et al., *Biochemistry* 31:5093–5099 (1992), the entirety of which is herein incorporated by reference).

Any of the nucleic acid molecules of the invention may either be modified by site directed mutagenesis or used as, for example, nucleic acid molecules that are used to target other nucleic acid molecules for modification. It is understood that mutants with more than one altered nucleotide can be constructed using techniques that practitioners are familiar with, such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241–243 (1991), the entirety of which is herein incorporated by reference) and molecular biochemical approaches, including the screening of recombinant cDNA libraries with antibodies (Landschulz et al., *Genes Dev.* 2:786–800 (1988), the entirety of which is herein incorporated by reference) or DNA probes (Bodner et al., *Cell* 55:505–518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4:839–849 (1992), the entirety of which is herein incorporated by reference; Schindler et al., *EMBO J.* 11:1261–1273 (1992), the entirety of which is herein incorporated by reference). An in situ screening protocol does not require the purification of the protein of interest (Vinson et al., *Genes Dev.* 2:801–806 (1988), the entirety of which is herein incorporated by reference, Singh et al., *Cell* 52:415–423 (1988), the entirety of which is herein incorporated by reference).

Two steps may be employed to characterize DNA-protein interactions. The first is to identify sequence fragments that interact with DNA-binding proteins, to titrate binding activity, to determine the specificity of binding and to determine whether a given DNA-binding activity can interact with related DNA sequences (Sambrook et al., *Molecular Cloning: A Laboratory Manual*, $2^{nd}$ edition, Cold Spring Harbor Laboratory Press, Cold Spring Harbor, N.Y. (1989)). Electrophoretic mobility-shift assay is a widely used assay. The assay provides a rapid and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9:6505–6525 (1981), the entirety of which is herein incorporated by reference). When one or more specific binding activities have been identified, the exact sequence of the DNA bound by the protein may be determined.

Several procedures for characterizing protein/DNA-binding sites are used, including methylation and ethylation interference assays (Maxam and Gilbert, *Methods Enzymol.* 65:499–560 (1980), the entirety of which is herein incorporated by reference; Wissman and Hillen, *Methods Enzymol.* 208:365–379 (1991), the entirety of which is herein incorporated by reference), footprinting techniques employing DNase I (Galas and Schmitz, *Nucleic Acids Res.* 5:3157–3170 (1978), the entirety of which is herein incorporated by reference), 1,10-phenanthroline-copper ion methods (Sigman et al., *Methods Enzymol.* 208:414–433 (1991), the entirety of which is herein incorporated by reference) and hydroxyl radicals methods (Dixon et al., *Methods Enzymol.* 208:414–433 (1991), the entirety of which is herein incorporated by reference). It is understood that one or more of the nucleic acid molecules of the invention may be utilized to identify a protein or fragment thereof that specifically binds to a nucleic acid molecule of the invention. It is also understood that one or more of the protein molecules or fragments thereof of the invention may be utilized to identify a nucleic acid molecule that specifically binds to it.

A two-hybrid system is based on the fact that proteins, such as transcription factors that interact (physically) with one another carry out many cellular functions. Two-hybrid systems have been used to probe the function of new proteins (Chien et al., *Proc. Natl. Acad. Sci. (U.S.A.)* 88:9578–9582 (1991) the entirety of which is herein incorporated by reference; Durfee et al., *Genes Dev.* 7:555–569 (1993) the entirety of which is herein incorporated by reference; Choi et al., *Cell* 78:499–512 (1994), the entirety of which is herein incorporated by reference; Kranz et al., *Genes Dev.* 8:313–327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci. (U.S.A.)* 91:12098–12984 (1994), the entirety of which is herein incorporated by reference), larger sets of hundreds of proteins (Bendixen et al., *Nucl. Acids Res.* 22:1778–1779 (1994), the entirety of which is herein incorporated by reference) and to comprehensively map proteins encoded by a small genome (Bartel et al., *Nature Genetics* 12:72–77 (1996), the entirety of which is herein incorporated by reference). This technique utilizes proteins fused to the DNA-binding domain and proteins fused to the activation domain. They are expressed in two different haploid yeast strains of opposite mating type and the strains are mated to determine if the two proteins interact. Mating occurs ashen haploid yeast strains come into contact and result in the fusion of the two haploids into a diploid yeast strain. An interaction can be determined by the activation of a two-hybrid reporter gene in the diploid strain.

The CLONTECH laboratories, Inc. provides the MATCHMAKER two-hybrid System kit (Cat. No. K1605-1) in which the sequences encoding the two functional domains of the GAL4 transcriptional activator, DNA binding domain and activation domain, are cloned into two different shuttle/expression sectors (pGBT9 and pGAD424) (Bartel ed al. In *Cellular Interactions in Development: A Practical Approach*. D. A. Hartley, ed., Oxford University Press, Oxford 153–179 (1993), the entirety of which is herein incorporated by reference). The gene code for the target protein is cloned into the pGBT9 to generate a hybrid of GAL4-DNA binding domain with a target protein and the gene(s) encode for potentially interacting protein(s) are cloned into the pGAD424 to create hybrid protein(s) of GAL4-activation domain with potentially interacting protein or with a collection of random proteins in a fusion library. The both plasmids carrying hybrid proteins are cotransformed into one yeast strain. Both hybrid proteins are targeted to the yeast nucleus by nuclear localization signal. If the target protein and the potentially interacting protein interact with each other, the GALA DNA binding domain and the GAL4 activation domain are brought to proximity and proper function of the transcriptional activator unit will be reconstituted resulting in transcription of reporter gene (lacZ or HIS3). An advantage of this technique is that it reduces the number of yeast transformations needed to test individual interactions. It is understood that the protein-protein interactions of protein or fragments thereof of the invention may be investigated using the two-hybrid system and that any of the nucleic acid molecules of the invention that encode such proteins or fragments thereof may be used to transform yeast in the two-hybrid system.

(f) Fungal Constructs and Fungal Transformants

The invention also relates to a fungal recombinant vector comprising exogenous genetic material The invention also relates to a fungal cell comprising a fungal recombinant vector. The invention also relates to methods for obtaining a recombinant fungal host cell comprising introducing into a fungal host cell exogenous genetic material.

Exogenous genetic material may be transferred into a fungal cell. In a preferred embodiment the exogenous genetic material includes a nucleic acid molecule of the present invention, preferably a nucleic acid molecule having a sequence selected from the group consisting of SEQ ID NO: 1 through SEQ ID NO: 621 or complements thereof or fragments of either. Another preferred class of exogenous genetic material are nucleic acid molecules that encode a protein having an amino acid selected from the group consisting of SEQ ID NO. 622 through SEQ ID NO: 626 or fragments thereof.

The fungal recombinant vector may be any vector which can be conveniently subjected to recombinant DNA procedures. The choice of a vector will typically depend on the compatibility of the vector with the fungal host cell into which the vector is to be introduced. The vector may be a linear or a closed circular plasmid. The vector system may be a single vector or plasmid or two or more vectors or plasmids which together contain the total DNA to be introduced into the genome of the fungal host.

The fungal vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the fungal cell, is integrated into the genome and replicated together with the chromosome(s) into which it has been integrated. This integration may be the result of homologous or non-homologous recombination.

Integration of a vector or nucleic acid into the genome by homologous recombination, regardless of the host being considered, relies on the nucleic acid sequence of the vector. Typically, the vector contains nucleic acid sequences for directing integration by homologous recombination into the genome of the host. These nucleic acid sequences enable the vector to be integrated into the host cell genome at a precise location or locations in one or more chromosomes. To increase the likelihood of integration at a precise location, there should be preferably two nucleic acid sequences that individually contain a sufficient number of nucleic acids, preferably 400 bp to 1500 bp, more preferably 800 bp to 1000 bp, which are highly homologous with the corresponding host cell target sequence. This enhances the probability of homologous recombination. These nucleic acid sequences may be any sequence that is homologous with a host cell target sequence and, furthermore, may or may not encode proteins.

For autonomous replication, the vector may further comprise an origin of replication enabling the vector to replicate autonomously, in the host cell in question. Examples of origin of replications for use in a yeast host cell are the 2 micron origin of replication and the combination of CEN3 and ARS 1. Any origin of replication may be used which is compatible with the fungal host cell of choice.

The fungal vectors of the invention preferably contain one or more selectable markers which permit easy selection of transformed cells. A selectable marker is a gene the product of which provides, for example biocide or viral resistance, resistance to heavy metals, prototrophy to auxotrophs and the like. The selectable marker may be selected from the group including, but not limited to, amdS (acetamidase), argB (ornithine carbamoyltransferase), bar (phosphinothricin acetyltransferase), hygB (hygromycin phosphotransferase), niaD (nitrate reductase), pyrG (orotidine-5'-phosphate decarboxylase) and sC (sulfate adenyltransferase) and trpC (anthranilate synthase). Preferred for use in an Aspergillus cell are the amdS and pyrG markers of *Aspergillus nidulans* or *Aspergillus oryzae* and the bar marker of *Streptomyces hygroscopicus*. Furthermore, selection may be accomplished by co-transformation, e.g., as described in WO 91/17243, the entirety of which is herein incorporated by reference. A nucleic acid sequence of the invention may be operably linked to a suitable promoter sequence. The promoter sequence is a nucleic acid sequence which is recognized by the fungal host cell for expression of the nucleic acid sequence. The promoter sequence contains transcription and translation control sequences which mediate the expression of the protein or fragment thereof.

A promoter may be any nucleic acid sequence which shows transcriptional activity in the fungal host cell of choice and may be obtained from genes encoding polypeptides either homologous or heterologous to the host cell. Examples of suitable promoters for directing the transcription of a nucleic acid construct of the invention in a filamentous fungal host are promoters obtained from the genes encoding *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase and hybrids thereof. In a yeast host, a useful promoter is the *Saccharomyces cerevisiae* enolase (eno-1) promoter. Particularly preferred promoters are the TAKA amylase, NA2-tpi (a hybrid of the promoters from the genes encoding *Aspergillus niger* neutral alpha-amylase and *Aspergillus oryzae* triose phosphate isomerase), glaA, *Saccharomyces cerevisiae* GAL1 (galactokinase) and *Saccharomyces cerevisiae* GPD (glyceraldehyde-3-phosphate dehydrogenase) promoters.

A protein or fragment thereof encoding nucleic acid molecule of the invention may also be operably linked to a terminator sequence at its 3' terminus. The terminator sequence may be native to the nucleic acid sequence encoding the protein or fragment thereof or may be obtained from foreign sources. Any terminator which is functional in the fungal host cell of choice may be used in the invention, but particularly preferred terminators are obtained from the genes encoding *Aspergillus oryzae* TAKA amylase, *Aspergillus niger* glucoamylase, *Aspergillus nidulans* anthranilate synthase, *Aspergillus niger* alpha-glucosidase, *Saccharomyces cerevisiae* cytochrome-c oxidase (CYC1) and *Saccharomyces cerevisiae* enolase.

A protein or fragment thereof encoding nucleic acid molecule of the invention may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the fungal host cell of choice may be used in the invention, but particularly preferred leaders are obtained from the genes encoding *Aspergillus oryzae* TAKA amylase and *Aspergillus oryzae* triose phosphate isomerase.

A polyadenylation sequence may also be operably linked to the 3' terminus of the nucleic acid sequence of the invention. The polyadenylation sequence is a sequence which when transcribed is recognized by the fungal host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the invention, but particularly preferred polyadenylation sequences are obtained from the genes encoding *Aspergillus oryzae* TAKA amylase, *Aspergillus niger* glucoamylase, *Aspergillus nidulans* anthranilate synthase, *Aspergillus niger* alpha-glucosidase and *Saccharomyces cerevisiae* cytochrome-c oxidase (CYC1).

To avoid the necessity of disrupting the cell to obtain the protein or fragment thereof and to minimize the amount of possible degradation of the expressed protein or fragment thereof within the cell, it is preferred that expression of the protein or fragment thereof gives rise to a product secreted outside the cell. To this end, a protein or fragment thereof of the invention may be linked to a signal peptide linked to the amino terminus of the protein or fragment thereof. A signal peptide is an amino acid sequence which permits the secretion of the protein or fragment thereof from the fungal host into the culture medium. The signal peptide may be native to the protein or fragment thereof of the invention or may be obtained from foreign sources. The 5' end of the coding sequence of the nucleic acid sequence of the invention may inherently contain a signal peptide coding region naturally linked in translation reading frame with the segment of the coding region which encodes the secreted protein or fragment thereof. Alternatively, the 5' end of the coding sequence may contain a signal peptide coding region which is foreign to that portion of the coding sequence which encodes the secreted protein or fragment thereof. The foreign signal peptide may be required where the coding sequence does not normally contain a signal peptide coding region. Alternatively, the foreign signal peptide may simply replace the natural signal peptide to obtain enhanced secretion of the desired protein or fragment thereof. The foreign signal peptide coding region may be obtained from a glucoamylase or an amylase gene from an Aspergillus species, a lipase or proteinase gene from *Rhizomucor miehei*, the gene for the alpha-factor from *Saccharomyces cerevisiae*, or the calf preprochymosin gene. An effective signal peptide for fungal host cells is the *Aspergillus oryzae* TAKA amylase signal, *Aspergillus niger* neutral amylase signal, the *Rhizomucor miehei* aspartic proteinase signal, the *Humicola lanuginosus* cellulase signal, or the *Rhizomucor miehei* lipase signal. However, any signal peptide capable of permitting secretion of the protein or fragment thereof in a fungal host of choice may be used in the invention.

A protein or fragment thereof encoding nucleic acid molecule of the invention may also be linked to a propeptide coding region. A propeptide is an amino acid sequence found at the amino terminus of aproprotein or proenzyme. Cleavage of the propeptide from the proprotein yields a mature biochemically active protein. The resulting polypeptide is known as a propolypeptide or proenzyme (or a zymogen in some cases). Propolypeptides are generally inactive and can be converted to mature active polypeptides by catalytic or autocatalytic cleavage of the propeptide from the propolypeptide or proenzyme. The propeptide coding region may be native to the protein or fragment thereof or may be obtained from foreign sources. The foreign propeptide coding region may be obtained from the *Saccharomyces cerevisiae* alpha-factor gene or *Myceliophthora thermophilia* laccase gene (WO 95/33836, the entirety of which is herein incorporated by reference).

The procedures used to ligate the elements described above to construct the recombinant expression vector of the invention are well known to one skilled in the art (see, for example, Sambrook et al., *Molecular Cloning, A Laboratory Manual*, 2nd ed., Cold Spring Harbor, N.Y., (1989)).

The invention also relates to recombinant fungal host cells produced by the methods of the invention which are advantageously used with the recombinant vector of the invention. The cell is preferably transformed with a vector comprising a nucleic acid sequence of the invention followed by integration of the vector into the host chromosome. The choice of fungal host cells will to a large extent depend upon the gene encoding the protein or fragment thereof and its source. The fungal host cell may, for example, be a yeast cell or a filamentous fungal cell.

"Yeast" as used herein includes Ascosporogenous yeast (Endomycetes). Basidiosporogenous yeast and yeast belonging to the *Fungi Imperfecti* (Blastomytes). The Ascosporogenous yeasts are divided into the families Spermophthoraceae and Saccharomycetaceae. The latter is comprised of four subfamilies. Schizosaccharomycoideae (for example, genus Schizosaccharomyces), Nadsoniodeae, Lipomycoideae and Saccharomycoideae (for example, genera Pichia, Kluyveromyces and Saccharomyces). The Basidiosporogenous yeasts include the genera Leucosporidim, Rhodosporidium, Sporidiobolus, Filobasidium and Filobasidiella. Yeast belonging to the *Fungi Imperfecti* are divided into two families, Sporobolomycetaceae (for example, genera Sorobolomyces and Bullera) and Cryptococcaceae (for example, genus Candida). Since the classification of yeast may chance in the future, for the purposes of this invention, yeast shall be defined as described in Biology and Activities of Yeast (Skinner et al., *Soc. App. Bacteriol. Symposium Series* No. 9, (1980), the entirety of which is herein incorporated by reference). The biology of yeast and manipulation of yeast genetics are well known in the art (see, for example, *Biochemistry and Genetics of Yeast*, Bacil et al. (ed.), 2nd edition, 1987; *The Yeasts*, Rose and Harrison (eds.), 2nd ed., (1987); and *The Molecular Biology of the Yeast Saccharomyces*, Strathern et al., (1981), all of which are herein incorporated by reference in their entirety).

"Fungi" as used herein includes the phyla Ascomycota, Basidiomycota, Chytridiomycota and Zygomycota (as defined by Hawksworth et al., In: Ainsworth and Bisby's *Dictionary of The Fungi*, $8^{th}$ edition, 1995, CAB International, University Press, Cambridge, UK; the entirety of which is herein incorporated by reference) as well as the Oomycota (as cited in Hawksworth et al., In: Ainsworth and Bisby's *Dictionary of The Fungi*, $8^{th}$ edition, 1995. CAB International, University Press, Cambridge, UK) and all mitosporic fungi (Hawksworth et al., In: Ainsworth and Bisby's *Dictionary of The Fungi*, $8^{th}$ edition, 1995, CAB International, University Press, Cambridge, UK). Representative groups of Ascomycota include, for example, Neurospora, Eupenicillium (=Penicillium), Emericella (=Aspergillus), Eurotiun (=Aspergillus) and the true yeasts listed above. Examples of Basidiomycota include mushrooms, rusts and smuts. Representative groups of Chytridiomycota include, for example, Allomayces, Blastocladiella, Coelomomyces and aquatic fungi. Representative groups of Oomycota include, for example, Saprolegniomycetous aquatic fungi (water molds) such as Achlya. Examples of mitosporic fungi include Aspergillus, Pennicilliun, Candida and Alternaria. Representative groups of Zygomycota include, for example, Rhizopus and Mucor.

"Filamentous fungi" include all filamentous forms of the subdivision Eumycota and Oomycota (as defined by Hawksworth et al., In: Ainsworth and Bisby's *Dictionary of The Fungi*. 8*th* edition, 1995, CAB International, University Press, Cambridge, UK). The filamentous fungi are characterized by a vegetative mycelium composed of chitin, cellulose, glucan, chitosan, mannan and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

In one embodiment, the fungal host cell is a yeast cell. In a preferred embodiment, the yeast host cell is a cell of the species of Candida, Kluyveromyces, Saccharomyces, Schizosaccaromyces, Pichia and Yarrowia. In a preferred embodiment, the yeast host cell is a *Saccharomyces cerevisiae* cell, a *Saccharomyces carlsbergensis, Saccharomyces diastaticus* cell, a *Saccharomyces douglassi* cell, a *Saccharomyces kluyveri* cell, a *Saccharomyces norbensis* cell, or a *Saccharomyces oviformis* cell. In another preferred embodiment, the yeast host cell is a *Kluyveromyces lactis* cell. In another preferred embodiment, the yeast host cell is a *Yarrowia lipolytica* cell.

In another embodiment, the fungal host cell is a filamentous fungal cell. In a preferred embodiment, the filamentous fungal host cell is a cell of the species of, but not limited to, Acremonium, Aspergillus, Fusarium, Humicola, Myceliophthora, Neurospora, Pennicillium, Thielavia, Tolypolcladium and Trichoderma.

The recombinant fungal host cells of the invention may further comprise one or more sequences which encode one or more factors that are advantageous in the expression of the protein or fragment thereof, for example, an activator (e.g., a trans-acting factor), a chaperone and a processing protease. The nucleic acids encoding one or more of these factors are preferably not operably linked to the nucleic acid encoding the protein or fragment thereof. An activator is a protein which activates transcription of a nucleic acid sequence encoding a polypeptide (Kudla et al., *EMBO* 9:1355–1364(1990): Jarai and Buxton, *Current Genetics* 26:2238–244(1994); Verdier, *Yeast* 6:271–297(1990), all of which are herein incorporated by reference in their entirety). The nucleic acid sequence encoding an activator may be obtained from the genes encoding *Saccharomyces cerevisiae* heme activator protein 1 (hap1), *Saccharomyces cerevisiae* galactose metabolizing protein 4 (gal4) and *Aspergillus nidulans* ammonia regulation protein (areA). For further examples, see Verdier, *Yeast* 6:271–297 (1990); MacKenzie et al., *Journal of Gen. Microbiol.* 139:2295–2307 (1993), both of which are herein incorporated by reference in their entirety). A chaperone is a protein which assists another protein in folding properly (Hartl et al., *TIBS* 19:20–25 (1994); Bergeron et al., *TIBS* 19:124–128 (1994); Demolder et al., *J. Biotechnology* 32:179–189 (1994); Craig, *Science* 260:1902–1903(1993); Gething and Sambrook, *Nature* 355:33–45 (1992); Puig and Gilbert, *J Biol. Chem.* 269:7764–7771 (1994); Wang and Tsou, *FASEB Journal* 7:1515–11157 (1993); Robinson et al., *Bio/Technology* 1:381–384 (1994), all of which are herein incorporated by reference in their entirety). The nucleic acid sequence encoding a chaperone may be obtained from the genes encoding *Aspergillus oryzae* protein disulphide isomerase, *Saccharomyces cerevisiae* calnexin, *Saccharomyces cerevisiae* BiP/GRP78 and *Saccharomyces cerevisiae* Hsp70. For further examples, see Gething and Sambrook, *Nature* 355:33–45 (1992); Hartl et al., *TIBS* 19:20–25 (1994). A processing protease is a protease that cleaves a propeptide to generate a mature biochemically active polypeptide (Enderlin and Ogrydziak, *Yeast* 10:67–79 (1994); Fuller et al., *Proc. Natl. Acad. Sci. (U.S.A.)* 86:1434–1438 (1989); Julius et al., *Cell* 37:1075–1089 (1984); Julius et al., *Cell* 32:839–852 (1983), all of which are incorporated by reference in their entirety). The nucleic acid sequence encoding a processing protease may be obtained from the genes encoding *Aspergillus niger* Kex2, *Saccharomyces cerevisiae* dipeptidylaminopeptidase. *Saccharomyces cerevisiae* Kex2 and *Yarrowia lipolytica* dibasic processing endoprotease (xpr6). Any factor that is functional in the fungal host cell of choice may be used in the invention.

Fungal cells may be transformed by a process involving protoplast formation, transformation of the protoplasts and regeneration of the cell wall in a manner known per se. Suitable procedures for transformation of Aspergillus host cells are described in EP 238 023 and Yelton et al., *Proc. Natl. Acad. Sci. (U.S.A.)* 81:1470–1474 (1984), both of which are herein incorporated by reference in their entirety. A suitable method of transforming Fusarium species is described by Malardier et al., *Gene* 78:147–156 (1989), the entirety of which is herein incorporated by reference. Yeast may be transformed using the procedures described by Becker and Guarente, In: Abelson and Simon, (eds.), *Guide to Yeast Genetics and Molecular Biology, Methods Enzymol*, Volume 194, pp. 182–187, Academic Press, Inc., New York; Ito et al., *J. Bacteriology* 153:163 (1983); Hinnen et al., *Proc. Natl. Acad. Sci. (U.S.A.)* 75:1920 (1978), all of which are herein incorporated by reference in their entirety.

The invention also relates to methods of producing the protein or fragment thereof comprising culturing the recombinant fungal host cells under conditions conducive for expression of the protein or fragment thereof. The fungal cells of the invention are cultivated in a nutrient medium suitable for production of the protein or fragment thereof using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the protein or fragment thereof to be expressed and/or isolated. The cultivation takes place in a suitable nutrient medium comprising carbon and nitrogen sources and inorganic salts, using procedures known in the art (see, e.g., Bennett and LaSure (eds.), *More Gene Manipulations in Fungi*, Academic Press, CA. (1991), the entirety of which is herein incorporated by reference). Suitable media are available from commercial suppliers or may be prepared according to published compositions (e.g., in catalogues of the American Type Culture Collection, Manassas, Va.). If the protein or fragment thereof is secreted into the nutrient medium, a protein or fragment thereof can be recovered directly from the medium. If the protein or fragment thereof is not secreted, it is recovered from cell lysates. The expressed protein or fragment thereof may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts. For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

(g) Mammalian Constructs and Transformed Mammalian Cells

The invention also relates to methods for obtaining a recombinant mammalian host cell, comprising introducing into a mammalian host cell exogenous genetic material. The invention also relates to a mammalian cell comprising a mammalian recombinant vector. The invention also relates to methods for obtaining a recombinant mammalian host cell, comprising introducing into a mammalian cell exogenous genetic material. In a preferred embodiment the exogenous genetic material includes a nucleic acid molecule of the present invention, preferably a nucleic acid molecule having a sequence selected from the group consisting of SEQ ID NO: 1 through SEQ ID NO: 621 or complements thereof or fragments of either. Another preferred class of exogenous genetic material are nucleic acid molecules that encode a protein having an amino acid selected from the group consisting of SEQ ID NO: 622 through SEQ ID NO: 626 or fragments thereof.

Mammalian cell lines available as hosts for expression are known in the art and include many immortalized cell lines available from the American Type Culture Collection (ATCC, Manassas, Va.), such as HeLa cells, Chinese hamster ovary (CHO) cells, baby hamster kidney (BHK) cells and a number of other cell lines.

Suitable promoters for mammalian cells are also known in the art and include viral promoters, such as those from Simian Virus 40 (SV40) (Fiers et al., *Nature* 273: 113 (1978)), Rous sarcoma virus (RSV), adenovirus (ADV), cytomecalovirus (CMYV), and bovine papilloma virus (BPV), as well as mammalian cell-derived promoters. An exemplary, non-limiting, list includes: a hematopoietic stem cell-specific promoter, such as the CD34 promoter (Burn et al., U.S. Pat. No. 5,556,954); the glucose-6-phospholase promoter (Yoshiuchi et al., *J. Clin. Endocrin. Metab.* 83:1016–1019 (1998)); interleukin-1 alpha promoter (Mori and Prager, *Leuk. Lymphoma* 26:421–433 (1997)); CMV promoter (Tong et al., *Anticancer Res.* 18:719–725 (1998), Norman et al., *Vaccine* 15:801–803 (1997)); RSV promoter (Elshami et al., *Cancer Gene Ther.* 4:213–221 (1997); Baldwin et al., *Gene Ther.* 4:1142–1149 (1997)); SV40 promoter (Harms and Splitter, *Hun. Gene Ther.* 6:1291–1297 (1995)); CD11c integrin gene promoter (Corbi and Lopez-Rodriguez, *Leuk. Lymphoma* 25:415–425 (1997)), GM-CSF promoter (Shannon et al., *Crit. Rev. Immunol.* 17:301–323 (1997)); interleukin-5R alpha promoter (Sun et al., *Curr. Top. Microbiol. Immunol* 211:173–187 (1996)); interleukin-2 promoter (Serfing et al., *Biochiem. Biophys. Acta* 1263:181–200 (1995); O'Neill et al., *Transplant Proc.* 23:2862–2866 (1991)); c-fos promoter (Janknecht, *Immunobiology* 193:137–142 (1995), Janknecht et al., *Carcinogenesis* 16:443–450 (1995), Takai et al., *Princess Takamatsu Symp.* 22:197–204 (1991)); h-ras promoter (Rachal et al., *EXS* 64:330–342 (1993)); and DMD gene promoter (Ray et al., *Adv. Exp. Med. Biol.* 280:107–111 (1990). All of the above documents are incorporated by reference in their entirety and can be relied on to make or use aspects of this invention, especially in designing and constructing appropriate vector and host expression systems.

Vectors used in mammalian cell expression systems may also include additional functional sequences. For example, terminator sequences, poly-A addition sequences, and internal ribosome entry site (IRES) sequences. Enhancer sequences, which increase expression, may also be included and sequences that promote amplification of the gene may also be desirable (for example, methotrexate resistance genes). One of skill in the art is familiar with numerous examples of these additional functional sequences, as well as other functional sequences, that may optionally be included in an expression vector.

Vectors suitable for replication in mammalian cells may include viral replicons, or sequences which insure integration of the appropriate sequences encoding HCV epitopes into the host genome. For example, another vector used to express foreign DNA is vaccinia virus. In this case, for example, a nucleic acid molecule encoding a protein or fragment thereof is inserted into the vaccinia genome. Techniques for the insertion of foreign DNA into the vaccinia virus genome are known in the art and may utilize, for example, homologous recombination. Such heterologous DNA is generally inserted into a gene which is non-essential to the virus, for example, the thymidine kinase gene (tk), which also provides a selectable marker. Plasmid vectors that greatly facilitate the construction of recombinant viruses have been described (see, for example, Mackett et al., *J Virol.* 49:857 (1984); Chakrabarti et al., *Mol. Cell. Biol.* 5:3403 (1985): Moss, In: *Gene Transfer Vectors For Mammilian Cells* (Miller and Calos, eds., Cold Spring Harbor Laboratory, N.Y., p. 10, (1987); all of which are herein incorporated by reference in their entirety). Expression of the HCV polypeptide then occurs in cells or animals which are infected with the live recombinant vaccinia virus.

The sequence to be integrated into the mammalian sequence may be introduced into the primary host by any convenient means, which includes calcium precipitated DNA, spheroplast fusion, transformation, electroporation, biolistics, lipofection, microinjection, or other convenient means. Where an amplifiable gene is being employed, the amplifiable gene may serve as the selection marker for selecting hosts into which the amplifiable gene has been introduced. Alternatively, one may include with the amplifiable gene another marker, such as a drug resistance marker, e.g., neomycin resistance (G418 in mammalian cells), hygromycin in resistance etc., or an auxotrophy marker (HIS3, TRP1, LEU2, URA3, ADE2, LYS2, etc.) for use in yeast cells.

Depending upon the nature of the modification and associated targeting construct, various techniques may be employed for identifying targeted integration. Conveniently, the DNA may be digested with one or more restriction enzymes and the fragments probed with an appropriate DNA fragment which will identify the properly sized restriction fragment associated with integration.

One may use different promoter sequences, enhancer sequences, or other sequence which will allow for enhanced levels of expression in the expression host. Thus, one may combine an enhancer from one source, a promoter region from another source, a 5'-noncoding region upstream from the initiation methionine from the same or different source as the other sequences and the like. One may provide for an intron in the non-coding region with appropriate splice sites or for an alternative 3'-untranslated sequence or polyadenylation site. Depending upon the particular purpose of the modification, any of these sequences may be introduced, as desired.

Where selection is intended, the sequence to be integrated will have with it a marker gene, which allows for selection. The marker gene may conveniently be downstream from the target gene and may include resistance to a cytotoxic agent, e.g., antibiotics, heavy metals, or the like, resistance or susceptibility to HAT, gancyclovir, etc., complementation to an auxotrophic host, particularly by using an auxotrophic yeast as the host for the subject manipulations, or the like. The marker gene may also be on a separate DNA molecule, particularly with primary mammalian cells. Alternatively, one may screen the various transformants, due to the high efficiency of recombination in yeast, by using hybridization analysis, PCR, sequencing, or the like.

For homologous recombination, constructs can be prepared where the amplifiable gene will be flanked, normally on both sides with DNA homologous with the DNA of the target region. Depending upon the nature of the integrating DNA and the purpose of the integration, the homologous DNA will generally be within 100 kb, usually 50 kb, preferably about 25 kb, of the transcribed region of the target gene, more preferably within 2 kb of the target gene. Where modeling of the gene is intended, homology will usually be present proximal to the site of the mutation. The homologous DNA may include the 5'-upstream region outside of the transcriptional regulatory region or comprising any enhancer sequences, transcriptional initiation sequences, adjacent sequences, or the like. The homologous region may include a portion of the coding region, where the coding region may be comprised only of an open reading frame or combination of exons and introns. The homologous region may comprise all or a portion of an intron, where all or a portion of one or more exons may also be present. Alternatively, the homologous region may comprise the 3'-region, so as to comprise all or a portion of the transcriptional termination region, or the region 3' of this region. The homologous regions may extend over all or a portion of the target gene or be outside the target gene comprising all or a portion of the transcriptional regulatory regions and/or the structural gene.

The integrating constructs may be prepared in accordance with conventional ways, where sequences may be synthesized, isolated from natural sources, manipulated, cloned, ligated, subjected to in vitro mutagenesis, primer repair, or the like. At various stages, the joined sequences may be cloned and analyzed by restriction analysis, sequencing, or the like. Usually during the preparation of a construct where various fragments are joined, the fragments, intermediate constructs and constructs will be carried on a cloning vector comprising a replication system functional in a prokaryotic host, e.g., *E. coli* and a marker for selection, e.g., biocide resistance, complementation to an auxotrophic host, etc. Other functional sequences may also be present, such as polylinkers, for ease of introduction and excision of the construct or portions thereof, or the like. A large number of cloning vectors are available such as pBR322 the pUC series, etc. These constructs may then be used for integration into the primary mammalian host.

In the case of the primary mammalian host, a replicating vector may be used. Usually, such vector will have a viral replication system, such as SV40, bovine papilloma virus, adenovirus, or the like. The linear DNA sequence vector may also have a selectable marker for identifying transfected cells. Selectable markers include the neo gene, allowing for selection with G418, the herpes tk gene for selection with HAT medium, the gpt gene with mycophenolic acid, complementation of an auxotrophic host, etc.

The vector may or may not be capable of stable maintenance in the host. Where the vector is capable of stable maintenance, the cells will be screened for homologous integration of the vector into the genome of the host, where various techniques for curing the cells may be employed. Where the vector is not capable of stable maintenance, for example, where a temperature sensitive replication system is employed, one may change the temperature from the permissive temperature to the non-permissive temperature, so that the cells may be cured of the vector. In this case, only those cells having integration of the construct comprising the amplifiable gene and, when present, the selectable marker, will be able to survive selection.

Where a selectable marker is present, one may select for the presence of the targeting construct by means of the selectable marker. Where the selectable marker is not present, one may select for the presence of the construct by the amplifiable gene. For the neo gene or the herpes tk gene, one could employ a medium for growth of the transformants of about 0.1–1 mg/ml of G418 or may use HAT medium, respectively. Where DHFR is the amplifiable gene, the selective medium may include from about 0.01–0.5 $\mu$M of methotrexate or be deficient in glycine-hypoxanthine-thymidine and have dialysed serum (GHT media).

The DNA can be introduced into the expression host by a variety of techniques that include calcium phosphate/DNA co-precipitates, microinjection of DNA into the nucleus, electroporation, yeast protoplast fusion with intact cells, transfection, polycations, e.g., polybrene, polyornithine, etc., or the like. The DNA may be single or double stranded DNA, linear or circular. The various techniques for transforming mammalian cells are well known (see Keown et al., *Methods Enzymol.* (1989); Keown et al., *Methods Enzymol.* 185:527–537 (1990); Mansour et al., *Nature* 336:348–352, (1988); all of which are herein incorporated by reference in their entirety).

(h) Insect Constructs and Transformed Insect Cells

The invention also relates to an insect recombinant vectors comprising exogenous genetic material. The invention also relates to an insect cell comprising an insect recombinant vector. The invention also relates to methods for obtaining a recombinant insect host cell, comprising introducing into an insect cell exogenous genetic material. In a preferred embodiment the exogenous genetic material includes a nucleic acid molecule of the present invention, preferably a nucleic acid molecule having a sequence selected from the group consisting of SEQ ID NO: 1 through SEQ ID NO: 621 or complements thereof or fragments of either. Another preferred class of exogenous genetic material are nucleic acid molecules that encode a protein having an amino acid selected from the group consisting of SEQ ID NO: 622 through SEQ ID NO: 626 or fragments thereof.

The insect recombinant vector may be any vector which can be conveniently subjected to recombinant DNA procedures and can bring about the expression of the nucleic acid sequence. The choice of a vector will typically depend on the compatibility of the vector with the insect host cell into which the vector is to be introduced. The vector may be a linear or a closed circular plasmid. The vector system may be a single vector or plasmid or two or more vectors or plasmids which together contain the total DNA to be introduced into the genome of the insect host. In addition, the insect vector may be an expression vector. Nucleic acid molecules can be suitably inserted into a replication vector for expression in the insect cell under a suitable promoter for insect cells. Many vectors are available for this purpose and selection of the appropriate vector will depend mainly on the size of the nucleic acid molecule to be inserted into the vector and the particular host cell to be transformed with the vector. Each vector contains various components depending on its function (amplification of DNA or expression of DNA) and the particular host cell with which it is compatible. The vector components for insect cell transformation generally include, but are not limited to, one or more of the following: a signal sequence, origin of replication, one or more marker genes and an inducible promoter.

The insect vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The sector may contain any means for assuring self-replication. Alternatively, the vector may be one which, when introduced into the insect cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the insect host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the insect host cell and, furthermore, may be non-encoding or encoding sequences.

Baculovirus expression vectors (BEVs) have become important tools for the expression of foreign genes, both for basic research and for the production of proteins with direct clinical applications in human and veterinary medicine (Doerfler, *Curr. Top. Miccrobiol. Immunol.* 131:51–68 (1968); Luckow and Summers, *Bio/Technology* 6:47–55 (1988a); Miller, *Annual Review of Microbiol.* 42: 177–199 (1988); Summers, *Curr. Comm. Molecular Biology*, Cold Spring Harbor Press, Cold Spring Harbor, N.Y. (1988); all of which are herein incorporated by reference in their entirety). BEVs are recombinant insect viruses in which the coding sequence for a chosen foreign gene has been inserted behind a baculovirus promoter in place of the viral gene, e.g., polyhedrin (Smith and Summers, U.S. Pat. No. 4,745,051, the entirety of which is incorporated herein by reference).

The use of baculovirus vectors relics upon the host cells being derived from Lepidopteran insects such as *Spodoptera frugiperda* or *Tricholplusia ni*. The preferred *Spodoptera frugiperda* cell line is the cell line Sf9. The *Spodoptera frugiperda* Sf9 cell line was obtained from American Type Culture Collection (Manassas, Va.) and is assigned accession number ATCC CRL 1711 (Summers and Smith, *A Manual of Methods for Baculovirus Vectors and Insect Cell Culture Procedures*, Texas Ag. Exper. Station Bulletin No. 1555 (1988), the entirety of which is herein incorporated by reference). Other insect cell systems, such as the silkworm *B. mori* may also be used.

The proteins expressed by the BEVs are, therefore, synthesized, modified and transported in host cells derived from Lepidopteran insects. Most of the genes that have been inserted and produced in the baculovirus expression vector system have been derived from vertebrate species. Other baculovirus genes in addition to the polyhedrin promoter may be employed to advantage in a baculovirus expression system. These include immediate-early (alpha), delayed-early (β), late (γ), or very late (delta), according to the phase of the viral infection during which they are expressed. The expression of these genes occurs sequentially, probably as the result of a "cascade"mechanism of transcriptional regulation. (Guarino and Summers, *J. Virol.* 57:563–571 (1986); Guarino and Summers, *J. Virol.* 61:2091–2099 (1987); Guarino and Summers, *Virol.* 162:444–451 (1988); all of which are herein incorporated by reference in their entirety).

Insect recombinant vectors are useful as intermediates for the infection or transformation of insect cell systems. For example, an insect recombinant vector containing a nucleic acid molecule encoding a baculovirus transcriptional promoter followed downstream by an insect signal DNA sequence is capable of directing the secretion of the desired biologically active protein from the insect cell. The vector may utilize a baculovirus transcriptional promoter region derived from any of the over 500 baculoviruses generally infecting insects, such as for example the Orders Lepidoptera, Diptera, Orthoptera, Coleoptera and Hymenoptera, including for example but not limited to the viral DNAs of *Autographa californica* MNPV, *Bombyx mori* NPV, *Tricoplusia ni* MNPV, *Rachiplusia ou* MNPV or *Galleria mellonella* MNPV, wherein said baculovirus transcriptional promoter is a baculovirus immediate-early gene IE1 or IEN promoter; an immediate-early gene in combination with a baculovirus delayed-early gene promoter region selected from the group consisting of 39K and a HindIII-k fragment delayed-early gene; or a baculovirus late gene promoter. The immediate-early or delayed-early promoters can be enchanced with transcriptional enhancer elements. The insect signal DNA sequence may code for a signal peptide of a Lepidopteran adipokinetic hormone precursor or a signal peptide of the *Manduca sexta* adipokinetic hormone precursor (Summers, U.S. Pat. No. 5,155,037; the entirety of which is herein incorporated by reference). Other insect signal DNA sequences include a signal peptide of the *Orthoptera Schistocerca gregaria* locust adipokinetic hormone precursor and the *Drosophilia melanogaster* cuticle genes CP1, CP2, CP3 or CP4 or for an insect signal peptide having substantially a similar chemical composition and function (Summers, U.S. Pat. No. 5,155, 037).

Insect cells are distinctly different from animal cells. Insects have a unique life cycle and have distinct cellular properties such as the lack of intracellular plasminogen activators in which are present in vertebrate cells. Another difference is the high expression levels of protein products ranging from 1 to greater than 500 mg/liter and the ease at which cDNA can be cloned into cells (Frasier, *In Vitro Cell. Dev. Biol* 25:225 (1989); Summers and Smith, In: *A Manual of Methods for Baculovirus Vectors and Insect Cell Culture Procedures*, Texas Ag. Exper. Station Bulletin No. 1555 (1988), both of which are incorporated by reference in their entirety).

Recombinant protein expression in insect cells is achieved by viral infection or stable transformation. For viral infection, the desired gene is cloned into baculovirus at the site of the wild-type polyhedron gene (Webb and Summers, *Technique* 2:173 (1990); Bishop and Posse, *Adv. Gene Technol.* 1:55 (1990); both of which are incorporated by reference in their entirety). The polyhedron gene is a component of a protein coat in occlusions which encapsulate virus particles. Deletion or insertion in the polyhedron gene results the failure to form occlusion bodies. Occlusion negative viruses are morphologically different from occlusion positive viruses and enable one skilled in the art to identify and purify recombinant viruses.

The vectors of invention preferably contain one or more selectable markers, which permit easy selection of transformed cells. A selectable marker is a gene the product of which provides, for example biocide or viral resistance, resistance to heavy metals, prototrophy to auxutrophs and the like. Selection may be accomplished by co-transformation, e.g., as described in WO 91/17243, a nucleic acid sequence of the invention may be operably linked to a suitable promoter sequence. The promoter sequence is a nucleic acid sequence, which is recognized by the insect host cell for expression of the nucleic acid sequence. The promoter sequence contains transcription and translation control sequences, which mediate the expression of the protein or fragment thereof. The promoter may be any nucleic acid sequence, which shows transcriptional activity in the insect host cell of choice and may be obtained from genes encoding polypeptides either homologous or heterologous to the host cell.

For example, a nucleic acid molecule encoding a protein or fragment thereof may also be operably linked to a suitable leader sequence. A leader sequence is a nontranslated region of a mRNA, which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence, which is functional in the insect host cell of choice may be used in the invention.

A polyadenylation sequence may also be operably linked to the 3' terminus of the nucleic acid sequence of the invention. The polyadenylation sequence is a sequence which when transcribed is recognized by the insect host to add polyadenosine residues to transcribed mRNA. The polyadenylation sequence may be native to the nucleic acid sequence encoding the protein or fragment thereof or may be obtained from foreign sources. Any polyadenylation sequence, which is functional in the fungal host of choice, may be used in the invention.

To avoid the necessity of disrupting the cell to obtain the protein or fragment thereof and to minimize the amount of possible degradation of the expressed polypeptide within the cell, it is preferred that expression of the poly peptide gene gives rise to a product secreted outside the cell. To this end, the protein or fragment thereof of the invention may be linked to a signal peptide linked to the amino terminus of the protein or fragment thereof. A signal peptide is an amino acid sequence which permits the secretion of the protein or fragment thereof from the insect host into the culture medium. The signal peptide may be native to the protein or fragment thereof of the invention or may be obtained from foreign sources. The 5' end of the coding sequence of the nucleic acid sequence of the invention may inherently contain a signal peptide coding region naturally linked in translation reading frame with the segment of the coding region which encodes the secreted protein or fragment thereof.

At present, a mode of achieving secretion of a foreign gene product in insect cells is by way of the foreign gene's native signal peptide. Because the foreign genes are usually from non-insect organisms, their signal sequences may be poorly recognized by insect cells and, hence, levels of expression may be suboptimal. However, the efficiency of expression of foreign gene products seems to depend primarily on the characteristics of the foreign protein. On average, nuclear localized or non-structural proteins are most highly expressed, secreted proteins are intermediate and integral membrane proteins are the least expressed. One factor generally affecting the efficiency of the production of foreign gene products in a heterologous host system is the presence of native signal sequences (also termed presequences, targeting signals, or leader sequences) associated with the foreign gene. The signal sequence is generally coded by a DNA sequence immediately following (5' to 3') the translation start site of the desired foreign gene.

The expression dependence on the type of signal sequence associated with a gene product can be represented by the following example. If a foreign gene is inserted at a site downstream from the translational start site of the baculovirus polyhedrin gene so as to produce a fusion protein (containing the N-terminus of the polyhedrin structural gene), the fused gene is highly expressed. But less expression is achieved when a foreign gene is inserted in a baculovirus expression vector immediately following the transcriptional start site and totally replacing the polyhedrin structural gene.

Insertions into the region −50 to −1 significantly alter (reduce) steady state transcription which, in turn, reduces translation of the foreign gene product. Use of the pVL941 vector optimizes transcription of foreign genes to the level of the polyhedrin gene transcription. Even though the transcription of a foreign gene may be optimal, optimal translation may vary because of several factors involving processing: signal peptide recognition, mRNA and ribosome binding, glycosylation, disulfide bond formation, sugar processing, oligomerization, for example.

The properties of the insect signal peptide are expected to be more optimal for the efficiency of the translation process in insect cells than those from vertebrate proteins. This phenomenon can generally be explained by the fact that proteins secreted from cells are synthesized as precursor molecules containing hydrophobic N-terminal signal peptides. The signal peptides direct transport of the select protein to its target membrane and are then cleaved by a peptidase on the membrane, such as the endoplasmic reticulum, when the protein passes through it.

Another exemplary insect signal sequence is the sequence encoding for Drosophila cuticle proteins such as CP1, CP2, CP3 or CP4 (Summers, U.S. Pat. No. 5,278,050; the entirety of which is herein incorporated by reference). Most of a 9 kb region of the Drosophila genome containing genes for the cuticle proteins has been sequenced. Four of the five cuticle genes contains a signal peptide coding sequence interrupted by a short intervening sequence (about 60 base pairs) at a conserved site. Conserved sequences occur in the 5 mRNA untranslated region, in the adjacent 35 base pairs of upstream flanking sequence and at −200 base pairs from the mRNA start position in each of the cuticle genes.

Standard methods of insect cell culture, cotransfection and preparation of plasmids are set forth in Summers and Smith (Summers and Smith, *A Manual of Methods for Baculovirus Vections and Insect Cell Procedures*, Texas Agricultural Experiment Station Bulletin No. 1555. Texas A&M University (1987)). Procedures for the cultivation of viruses and cells are described in Volkman and Summers, *J. Virol.* 19:820–832 (1975) and Volkman et al., *J. Virol* 19:820–832 (1976): both of which are herein incorporated by reference in their entirety.

(i) Bacterial Constructs and Transformed Bacterial Cells

The invention also relates to a bacterial recombinant vector comprising exogenous genetic material. The invention also relates to a bacteria cell comprising a bacterial recombinant vector. The invention also relates to methods for obtaining a recombinant bacteria host cell, comprising introducing into a bacterial host cell exogenous genetic material. In a preferred embodiment the exogenous genetic material includes a nucleic acid molecule of the present invention, preferably a nucleic acid molecule having a sequence selected from the group consisting of SEQ ID NO. 1 through SEQ ID NO: 621 or complements thereof or fragments of either. Another preferred class of exogenous genetic material are nucleic acid molecules that encode a protein having an amino acid selected from the group consisting of SEQ ID NO: 622 through SEQ ID NO: 626 or fragments thereof.

The bacterial recombinant vector may be any vector that can be conveniently subjected to recombinant DNA procedures. The choice of a vector will typically depend on the compatibility of the vector with the bacterial host cell into which the vector is to be introduced. The vector may be a linear or a closed circular plasmid. The vector system may be a single vector or plasmid or two or more vectors or plasmids, which together contain the total DNA to be introduced into the genome of the bacterial host. In addition, the bacterial vector may be an expression vector. Nucleic acid molecules encoding protein homologues or fragments thereof can, for example, be suitably inserted into a replicable vector for expression in the bacterium under the control of a suitable promoter for bacteria. Many vectors are available for this purpose and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more marker genes and an inducible promoter.

In general, plasmid vectors containing replicon and control sequences that are derived from species compatible with the host cell are used in connection with bacterial hosts. The sector ordinarily carries a replication site, as well as marking sequences that are capable of providing phenotypic selection in transformed cells. For example, *E. coli* is typically transformed using pBR322, a plasmid derived from an *E. coli* species (see, e.g., Bolivar et al., *Gene* 2:95 (1977), the entirety of which is herein incorporated by reference). The plasmid pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding protein or fragments thereof may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence selected, for example, from the group consisting of the alkaline phosphatase, penicillinase, lpp, or heat-stable enterotoxin II leaders.

Both expression and cloning vectors contain a nucleic acid sequence that enables the vector to replicate in one or more selected host cells. Generally, in cloning vectors this sequence is one that enables the vector to replicate independently of the host chromosomal DNA and includes origins of replication or autonomously replicating sequences. Such sequences are well known for a variety of bacteria. The origin of replication from the plasmid pBR322 is suitable for most Gram-negative bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins,, e.g., ampicillin. neomycin, methotrexate, or tetracycline. (b) complement auxotrophic deficiencies, or (c) supply critical nutrients not available from complex media, e.g., the gene encoding D-alanine racemase for Bacilli. One example of a selection scheme utilizes a drug to arrest growth of a host cell. Those cells that are successfully transformed with a heterologous protein homologue or fragment thereof produce a protein conferring drug resistance and thus survive the selection regimen.

The expression vector for producing a protein or fragment thereof can also contains an inducible promoter that is recognized by the host bacterial organism and is operably linked to the nucleic acid encoding, for example, the nucleic acid molecule encoding the protein homologue or fragment thereof of interest. Inducible promoters suitable for use with bacterial hosts include the β-lactamase and lactose promoter systems (Chang et al., *Nature* 275:615 (1978); Goeddel et al., *Nature* 281:544 (1979); both of which are herein incorporated by reference in their entirety), the arabinose promoter system (Guzman et al., *J. Bacteriol.* 174:7716–7728 (1992); the entirety of which is herein incorporated by reference), alkaline phosphatase, a tryptophan (trp) promoter system (Goeddel, *Nucleic Acids Res.* 8:4057 (1980); EP 36,776; both of which are herein incorporated by reference in their entirety) and hybrid promoters such as the tac promoter (deBoer et al., *Proc. Natl. Acad. Sci.* (*USA*) 80:21–25 (1983); the entirety of which is herein incorporated by reference). However, other known bacterial inducible promoters are suitable (Siebenlist et al., *Cell* 20:269 (1980); the entirety of which is herein incorporated by reference).

Promoters for use in bacterial systems also generally contain a Shine-Dalgarno (S.D.) sequence operably linked to the DNA encoding the polypeptide of interest. The promoter can be removed from the bacterial source DNA by restriction enzyme digestion and inserted into the vector containing the desired DNA.

Construction of suitable sectors containing one or more of the above-listed components employs standard ligation techniques. Isolated plasmids or DNA fragments are cleaved, tailored and re-ligated in the form desired to generate the plasmids required. Examples of available bacterial expression sectors include, but are not limited to: the multifunctional *E. coli* cloning and expression vectors such as Bluescript™ (Stratagene, La Jolla, Calif.), in which, for example, encoding an *A. nidulans* protein homologue or fragment thereof homologue, may be ligated into the vector in frame with sequences for the amino-terminal Met and the subsequent 7 residues of β-galactosidase so that a hybrid protein is produced; pIN vectors (Van Heeke and Schuster, *J. Biol. Chem.* 264:5503–5509 (1989), the entirety of which is herein incorporated by reference); and the like. pGEX vectors (Promega, Madison Wis. U.S.A.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to optionally include a heparin, thrombin, or factor XA protease cleavage sites so that the cloned polypeptide of interest can be released from the GST moiety at will. Proteins or polypeptides of the invention can be expressed as variants that facilitate purification. For example, a fusion protein to such proteins as maltose binding protein (MBP), glutathione-S-transferase (GST) or thioredoxin (TRX) are known in the art [New England BioLab, Beverly, Mass., Pharmacia, Piscataway, N.J., and InVitrogen, San Diego, Calif.]. The polypeptide or protein can also be a tagged variant to facilitate purification, such as with histidine or methionine rich regions (His-Tag; available from LifeTechnologies Inc. Gaithersburg, Md.) that bind to metal ion affinity chromatography columns, or with an epitope that binds to a specific antibody (Flag, available from Kodak, New Haven, Conn.). An exemplary, non-limiting list of commercially available vectors suitable for fusion protein expression includes: pBR322 (Promega); pGEX (Amersham); pT7 (USB); pET (Novagen); pIBI (IBI); pProEX-1 (Gibco/BRL); pBluescript II (Stratagene); pTZ18R and pTZ19R (USB); pSE420 (Invitrogen); pVL1392 (Invitrogen); pBlueBac (Invitrogen); pBAcPAK (Clontech); pHIL (Invitrogen); pYES2 (Invitrogen); pCDNA (Invitrogen); and pREP (Invitrogen). A number of other purification methods or means are also known and can be used. Reverse-phase high performance liquid chromatography (RP-HPLC), optionally employing hydrophobic RP-HPLC media, e.q., silica gel, further purify the protein. Combinations of methods and means can also be employed to provide a substantially purified recombinant polypeptide or protein. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript Registered TM (Stratagene, La Jolla, Calif.), in which, for example, encoding an gene homologue or fragment thereof homologue, may be ligated into the vector in frame with sequences for the amino-terminal Met and the subsequent 7 residues of beta-galactosidase so that a hybrid protein is produced; pIN vectors (Van Heeke and Schuster *J. Biol. Chem.* 264: 5503–5509 (1989). The entirety of which is herein incorporated by reference); and the like. pGEX vectors (Promega, Madison Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

Suitable host bacteria for a bacterial vector include archaebacteria and eubacteria, especially eubacteria and most preferably Enterobacteriaceae. Examples of useful bacteria include Escherichia, Enterobacter, Azotobacter, Erwinia, Bacillus, Pseudomonas, Klebsiella, Proteus, Salmonella, Serratia, Shigella, Rhizobia, Vitreoscilla and Paracoccus. Suitable *E. coli* hosts include *E. coli* W3110 (American Type Culture Collection (ATCC) 27,325, Manassas, Va. U.S.A.), *E. coli* 294 (ATCC 31,446), *E. coli* B and *E. coli* X1776 (ATCC 31,537). These examples are illustrative rather than limiting. Mutant cells of any of the above-mentioned bacteria may also be employed. It is, of course, necessary to select the appropriate bacteria taking into consideration replicability of the replicon in the cells of a bacterium. For example, *E. coli*, Serratia, or Salmonella species can be suitably used as the host when well known plasmids such as pBR322, pBR325, pACYC177, or pKN410 are used to supply the replicon. *E. coli* strain W3110 is a preferred host or parent host because it is a common host strain for recombinant DNA product fermentations. Preferably, the host cell should secrete minimal amounts of proteolytic enzymes.

Host cells are transfected and preferably transformed with the above-described sectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988); the entirety of which is herein incorporated by reference). Yet another method is the use of the technique termed electroporation.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York; Cold Spring Harbor Laboratory Press, (1989). Examples of suitable media are Vixen in U.S. Pat. Nos. 5,304,472 and 5,342,763; both of which are incorporated by reference in their entirety.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA*, 1, Cold Spring Harbor, N.Y., the entirety of which is herein incorporated by reference).

(j) Algal Constructs and Algal Transformants

The present invention also relates to an algal recombinant vector comprising exogenous genetic material. The present invention also relates to an algal cell comprising an algal recombinant vector. The present invention also relates to methods for obtaining a recombinant algal host cell comprising introducing into an algal host cell exogenous genetic material.

Exogenous genetic material is any genetic material, whether naturally occurring or otherwise, from any source that is capable of being inserted into any organism. Exogenous genetic material may be transferred into an algal cell. In a preferred embodiment the exogenous genetic material includes a nucleic acid molecule having a sequence selected from the group consisting of SEQ ID NO: 1 through SEQ ID NO: 621 or complements thereof. Another preferred class of exogenous genetic material are nucleic acid molecules that encode a protein having an amino acid selected from the group consisting of SEQ ID NO: 622 through SEQ ID NO: 626 or fragments thereof.

The algal recombinant vector may be any vector which can be conveniently subjected to recombinant DNA procedures. The choice of a vector will typically depend on the compatibility of the vector with the algal host cell into which the vector is to be introduced. The vector may be a linear or a closed circular plasmid. The vector system may be a single vector or plasmid or two or more vectors or plasmids which together contain the total DNA to be introduced into the genome of the algal host.

The algal vector may be an autonomously replicating vector, i.e., a vector which exists as an extrachromosomal entity, the replication of which is independent of chromosomal replication. e.g., a plasmid, an extrachromosomal element, a minichromosome, or an artificial chromosome. The vector may contain any means for assuring self-replication. Alternatively, the vector may be one which, when introduced into the algal cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the algal host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the algal host cell, and, furthermore, may be non-encoding or encoding sequences.

The vectors of the present invention preferably contain one or more selectable markers which permit easy selection of transformed cells. A selectable marker is a gene, the product of which confers upon an algal cell resistance to a compound to which the algal would otherwise be sensitive. The compound can be selected from the group consisting of antibiotics, fungicides, herbicides, and heavy metals. The selectable marker may be selected from any known or subsequently identified selectable markers, including markers derived from algal, fungal, and bacterial sources. Preferred selectable markers can be selected from the group including, but not limited to, amdS (acetamidase), argB (ornithine carbamoyltransferase), bar (phosphinothricin acetyltransferase), ble (bleomycin binding protein), cat (chloramphenicol acetyltransferase), hygB (hygromycin B phosphotransferase), nat (nourseothricin acetyltransferase), niaD (nitrate reductase), neo (neomycin phosphotransferase), pac puromycin acetyltransferase), pyrG (orotidine-5'-phosphate decarboxylase), sat (streptothricin acetyltransferase), sC (sulfate adenyltransferase), trpC (anthranilate synthase), and glyphosate resistant EPSPS genes. Furthermore, selection may be accomplished by co-transformation, e.g., as described in WO 91/172143, herein incorporated by reference in its entirety.

A nucleic acid sequence of the present invention may be operably linked to a suitable promoter sequence. The promoter sequence is a nucleic acid sequence which is recognized by the algal host cell for expression of the nucleic acid sequence. The promoter sequence contains transcription and translation control sequences which mediate the expression of the protein or fragment thereof.

A promoter may be any nucleic acid sequence which shows transcriptional activity in the algal host cell of choice and may be obtained from genes encoding polypeptides either homologous or heterologous to the host cell. Examples of suitable promoters for directing the transcription of a nucleic acid construct of the invention in an algal host are light harvesting protein promoters obtained from photosynthetic organisms, Chorella virus methyltransferase promoters, CaMV 35 S promoter, PL promoter from bacteriophage λ, nopaline synthase promoter from the Ti plasmid of *Agrobacterium tumefaciens*, and bacterial trp promoter.

A protein or fragment thereof encoding nucleic acid molecule of the present invention may also be operably linked to a terminator sequence at its 3' terminus. The terminator sequence may be native to the nucleic acid sequence encoding the protein or fragment thereof or may be obtained from foreign sources. Any terminator which is functional in the algal host cell of choice may be used in the present invention.

A protein or fragment thereof encoding nucleic acid molecule of the present invention may also be operably linked to a suitable leader sequence. A leader sequence is a nontranslated region of a mRNA which is important for translation by the algal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the algal host cell of choice may be used in the present invention.

A polyadenylation sequence may also be operably linked to the 3' terminus of the nucleic acid sequence of the present invention. The polyadenylation sequence is a sequence which when transcribed is recognized by the algal host to add polyadenosine residues to transcribed mRNA.

The polyadenylation sequence may be native to the nucleic acid sequence encoding the protein or fragment thereof or may be obtained from foreign sources. Any polyadenylation sequence which is functional in the algal host of choice may be used in the present invention.

The procedures used to ligate the elements described above to construct the recombinant expression vector of the present invention are well known to one skilled in the art (see, for example, Sambrook, 2nd ed., et al., *Molecular Cloning, A Laboratory Manual* Cold Spring Harbor, N.Y., (1989), herein incorporated by reference in its entirety).

The present invention also relates to recombinant algal host cells produced by the methods of the present invention which are advantageously used with the recombinant vector of the present invention. The cell is preferably transformed with a vector comprising a nucleic acid sequence of the invention followed by integration of the vector into the host chromosome. The choice of algal host cells will to a large extent depend upon the gene encoding the protein or fragment thereof and its source.

Algal cells may be transformed by a variety of known techniques, including but not limit to, microprojectile bombardment, protoplast fusion, electroporation, microinjection, and vigorous agitation in the presence of glass beads. Suitable procedures for transformation of green algal host cells are described in EP 108 580, herein incorporated by reference in its entirety. A suitable method of transforming Chlorella species is described by Jarvis and Brown, *Curr. Genet.* 19: 317–321 (1991), herein incorporated by reference in its entirety. A suitable method of transforming cells of diatom *Phaeodactylum tricornutum* species is described in WO 97/39106, herein incorporated by reference in its entirety. Chlorophyll C-containing algae maybe transformed using the procedures described in U.S. Pat. No. 5,661,017, herein incorporated by reference in its entirety.

The expressed protein or fragment thereof may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts. For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

Computer Readable Media

The nucleotide or amino acid sequence provided in SEQ ID NO: 1 through SEQ ID NO: 626, or fragment thereof, or complement thereof, or a nucleotide or an amino acid sequence at least 70% identical, preferably 90% identical even more preferably 99% or about 100% identical to the sequence provided in SEQ ID NO: 1 through SEQ ID NO: 626, or where appropriate complement thereof or fragments of either, can be "provided" in a variety of mediums to facilitate use. Such a medium can also provide a subset thereof in a form that allows a skilled artisan to examine the sequences.

A further preferred subset of nucleic acid sequences is where the subset of sequences is two proteins or fragments thereof, more preferably three proteins or fragments thereof and even more preferable four proteins or fragments thereof.

In one application of this embodiment, a nucleotide sequence of the invention can be recorded on computer readable media so that a computer-readable medium comprises one or more of the nucleotide sequences of the invention. As used herein, "computer readable media" refers to any medium that can be read and accessed directly by a computer. Such media include, but are not limited to: magnetic storage media, such as floppy discs, hard disc, storage medium and magnetic tape; optical storage media such as CD-ROM; electrical storage media such as RAM and ROM; and hybrids of these categories such as magnetic/optical storage media.

Any number of the sequences, or sequence fragments, of the nucleic acid molecules or proteins of the invention, or fragments of either, can be included, in any number of combinations, on a computer-readable medium. Specifically, any one or more of SEQ ID NO: 1–626, or where appropriate, complements thereof, can be included.

A skilled artisan can readily appreciate how any computer readable medium can be used to create a machine or method comprising a computer readable medium having recorded thereon a nucleotide sequence of the invention. As used herein, "recorded" refers to a process for storing information on computer readable medium. A skilled artisan can readily adopt any method for recording information on computer readable medium to generate media comprising the nucleotide sequence information of the invention. A variety of data storage structures are available to a skilled artisan for creating a computer readable medium having recorded thereon a nucleotide sequence of the invention. The choice of the data storage structure will generally be based on the means chosen to access the stored information. In addition, a variety of data processor programs and formats can be used to store the nucleotide sequence information of the invention on computer readable medium. The sequence information can be represented in a word processing text file, formatted in commercially-available software such as WordPerfect or Microsoft Word, or represented in the form of an ASCII file, stored in a database application, such as DB2, Sybase, Oracle, or the like. A skilled artisan can readily adapt any number of data processor structuring formats (e.g., text file or database) in order to obtain computer readable medium having recorded thereon the nucleotide sequence information of the invention.

By providing one or more of nucleotide sequences of the invention, a skilled artisan can routinely access the sequence information for a variety of purposes. Computer software is publicly available that allows a skilled artisan to access sequence information provided in a computer readable medium. The examples which follow demonstrate how software which implements the BLAST (Altschul et al., *J. Mol. Biol.* 215:403–410 (1990), the entirety of which is herein incorporated by reference) and BLAZE (Brutlag et al., *Comp. Chem.* 17:203–207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the invention and are useful in producing commercially important proteins such as enzymes used in amino acid biosynthesis, metabolism, transcription, translation, RNA processing, nucleic acid and a protein degradation, protein modification and DNA replication, restriction, modification, recombination and repair.

The invention further provides systems, particularly computer-based systems, which contain the sequence information described herein. Such systems are designed to identify commercially important fragments of the nucleic acid molecule of the invention. As used herein, "a computer-based system" refers to the hardware means, software means and data storage means used to analyze the nucleotide sequence information of the invention. The minimum hardware means of the computer-based systems of the invention comprises a central processing unit (CPU), input means, output means and data storage means. A skilled artisan can readily appreciate that any one of the currently available computer-based system are suitable for use in the invention.

As indicated above, the computer-based systems of the invention comprise a data storage means having stored therein a nucleotide sequence of the invention and the necessary hardware means and software means for supporting and implementing a search means. As used herein, "data storage means" refers to memory that can store nucleotide sequence information of the invention, or a memory access means which can access manufactures having recorded thereon the nucleotide sequence information of the invention. As used herein, "search means" refers to one or more programs which are implemented on the computer-based system to compare a target sequence or target structural motif with the sequence information stored within the data storage means. Search means are used to identify fragments or regions of the sequence of the invention that match a particular target sequence or target motif. A variety of known algorithms are disclosed publicly and a variety of commercially available software for conducting search means are available can be used in the computer-based systems of the invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the invention, such as sequence fragments involved in gene expression and protein processing, may be of shorter length.

As used herein, "a target structural motif," or "target motif," refers to any rationally selected sequence or combination of sequences in which the sequences the sequence (s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the invention further provides an input means for receiving a target sequence, a data storage means for storing the target sequences of the invention sequence identified using a search means as described above and an output means for outputting the identified homologous sequences.

A variety of structural formats for the input and output means can be used to input and output information in the computer-based systems of the invention. A preferred format for an output means ranks fragments of the sequence of the invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the invention. For example, implementing software which implement the BLAST and BLAZE algorithms (Altschul et al., *J. Mol. Biol.* 215:403410 (1990)) can be used to identify open frames within the nucleic acid molecules of the invention. A skilled artisan can readily recognize that any one of the publicly available homology search programs can be used as the search means for the computer-based systems of the invention.

Having now described the invention, the following examples are provided by way of illustration and are not intended to limit the scope of the invention, unless specified.

EXAMPLE 1

Identification of Yeast HES1

The yeast strain LPY9 (MATa, leu2, Ura3, his3) is grown overnight and inoculated into SD+ hul (histidine, uracil, leucine) media. Aliquots of the culture are treated with ketoconazole (an inhibitor of C-14α demethylase ($P450_{14DM}$) enzyme) at 10 ug/ml, 50 ug/ml, and 100 ug/ml, corresponding to 10 ppm, 50 ppm, and 100 ppm, respectively. A sample of each is collected at 2, 4, and 6 hours after treatment. Control samples treated with DMSO (dimethyl sulfoxide-solvent for ketoconazole) but not with ketoconazole are also collected. Total RNA from each sample is collected by conventional methods, such as a Zirconium/Silica bead binding and extraction method. The sequence content of each sample is analyzed and compared by hybridizing each of them to a number of yeast ORF sequences immobilized on a Nylon membrane in an array format.

A similar comparison of a wild type yeast strain and a double mutant strain is made. The double mutant CJ517 (MATa, erg11::URA3, erg3::LEU2, leu2, ura3, his4) [erg11, erg3 double mutant] is compared to LPY9 after growth in both YPD and SD+hul media. Samples are collected at approximately 0, 2, 4, and 6 hours after inoculation.

Table 2, below, lists the RNAs in each sample whose abundance is effected by ketoconazole treatment or whose abundance differs between wild type and the double mutant strain. The table also lists the corresponding gene or sequence identifier for those RNAs. The RNAs are ranked by the ratio of either ketocanozole vs. control or mutant vs. control, using the ratio of 50 ppm ketocanozole/control as a basis for comparison.

TABLE 2*

| Seq. Num. | Clone ID | ALIAS | CJ-4hr/ LP-4hr | K-50/CK | K-100/CK | Gene Description |
|---|---|---|---|---|---|---|
| 30 | YOR237W | (HES1) | 134.648161 | 1417.6262 | 1358.1235 | Protein implicated in ergosterol biosynthesis, member of the KES1/HES1/OSH1/YKR003W family of oxysterol-binding (OSBP) proteins |

TABLE 2*-continued

| Seq. Num. | Clone ID | ALIAS | CJ-4hr/ LP-4hr | K-50/CK | K-100/CK | Gene Description |
|---|---|---|---|---|---|---|
| 31 | YKL198C | (PTK1) | 68.5845326 | 111.1984 | 233.11762 | Serine/threonine protein kinase, activator of low-affinity, low-capacity polyamine transport |
| 32 | YLR465C | — | 97.9601498 | 104.52215 | 133.57826 | Protein of unknown function, questionable ORF |
| 33 | YMR129W | (POM152) | 5.10206225 | 82.813831 | 15.392788 | Nuclear pore membrane glycoprotein, type II integral membrane protein with N-terminal region on pore side and C-terminal region in the cisternae |
| 34 | YBR284W | — | 4.92774291 | 60.027955 | 8.5359554 | Protein with similarity to AMP deaminase |
| 35 | YKL158W | — | 11.6717854 | 59.827307 | 75.220412 | Protein of unknown function |
| 36 | YOR083W | — | 31.7378598 | 51.606081 | 42.301568 | Protein of unknown function |
| 37 | YOL095C | — | 3.60507866 | 49.740211 | 21.834188 | Protein with similarity to S. aureus DNA helicase PCRA |
| 38 | YOR188W | (MSB1) | 2.19997209 | 42.446767 | 61.303817 | Protein that may play a role in polarity establishment and bud formation |
| 39 | YBL109W | — | 0.08616121 | 38.653463 | 75.964757 | — |
| 40 | YLR091W | — | 17.5946744 | 38.325073 | 44.556481 | Protein of unknown function |
| 41 | YNL106C | (INP52) | 2.52986454 | 35.205536 | 17.376557 | — |
| 42 | YDR213W | — | 18.2079478 | 32.136065 | 58.358612 | Protein with similarity to transcription factors, has ZN[2]-CYS[6] fungal-type binuclear cluster domain in the N-terminal region |
| 43 | YBL004W | — | 8.49387973 | 28.614573 | 28.645633 | Protein with similarity to members of the major facilitator superfamily (MFS) |
| 44 | YIR019C | (MUC1) | 48.7538739 | 27.594853 | 137.77885 | Glucoamylase 1 (alpha-1,4-glucan glucosidase), extracellular enzyme |
| 45 | YIL182C | — | 2.53469593 | 26.891434 | 29.499298 | Protein of unknown function |
| 46 | YMR254C | — | 0.19897977 | 26.633459 | 10.625738 | Protein of unknown function, questionable ORF |
| 47 | YDL134C | (PPH21) | 3.51284473 | 22.849241 | 0 | — |
| 48 | YCR098C | (G1T1) | 2.27672091 | 21.746838 | 24.724171 | Protein involved in inositol metabolism |
| 49 | YPL150W | — | 4.72964069 | 21.633895 | 34.40982 | Serine/threonine protein kinase of unknown function |
| 50 | YKL110C | (KTI12) | 19.7752946 | 21.085633 | 16.303432 | Protein involved in resistance to kluyveromyces lactis killer toxin |
| 51 | YER011W | (TIR1) | 31.4723195 | 20.454605 | 17.935906 | Stress-induced cell wall structural protein of the PAU1 family |
| 52 | YDL024C | — | 3.96163383 | 20.381493 | 30.488098 | Protein with similarity to acid phosphatases |
| 53 | YGR013W | — | 0.10491681 | 20.364081 | 0 | — |
| 54 | YOR325W | — | 47.3518002 | 20.211317 | 29.305064 | Protein of unknown function |
| 55 | YJR150C | — | 159.265973 | 19.793221 | 13.560079 | — |
| 56 | YDL126C | (CDC48) | 42.7590386 | 19.0472 | 15.014024 | Protein of the AAA family of ATPases, required for cell division and homotypic membrane fusion |
| 57 | YLR464W | — | 12.4297115 | 18.580843 | 36.516503 | Protein with similarity to other subtelomerically-coded proteins |
| 58 | YLR124W | — | 0.13902212 | 18.351487 | 11.026125 | Protein of unknown function |
| 59 | YLR463C | — | 8.49721471 | 18.007814 | 29.811632 | Protein with similarity to other subtelomerically-coded proteins |
| 60 | YMR297W | (PRC1) | 6.20117404 | 17.995865 | 24.291751 | Carboxypeptidase Y (CPY) (YSCY), serine-type protease |
| 61 | YFL029C | (CAK1) | 17.1104765 | 16.96782 | 44.352291 | CDK-activating kinase (serine/threonine protein kinase) responsible for in vivo activation of CDC28P, also involved in spore wall formation |
| 62 | YER054C | (GIP2) | 2.14214491 | 16.442373 | 15.284537 | GLC7P-interacting protein, possible regulatory subunit for the PP1 family protein phosphatase GLC7P |
| 63 | YER060W-A | (FCY22) | 2.61677424 | 15.768882 | 20.550953 | Purine-cytosine permease with similarity to FCY2P, member of the purine/cytosine family of the major facilitator superfamily (MFS) |
| 64 | YEL076C | — | 13.7918147 | 14.372278 | 26.325282 | Protein with similarity to other subtelomerically-encoded proteins |
| 65 | YGL176C | — | 9.0823019 | 14.17085 | 16.23816 | Protein with similarity to discopyge OMMATA CA++ channel alpha 1 subunit protein B47447 |
| 66 | YNR005C | — | 12.9230524 | 14.032659 | 13.011356 | Protein of unknown function, questionable ORF |
| 67 | YML032C-A | — | 6.92372404 | 13.847081 | 5.501802 | — |
| 68 | YGR190C | — | 22.9885796 | 13.701633 | 42.22779 | Protein of unknown function |
| 69 | YHR213W | — | 17.3140804 | 13.267403 | 21.010074 | Protein with similarity to the N-terminus of FLO1P and identical to YAR062P, probable pseudogene |

TABLE 2*-continued

| Seq. Num. | Clone ID | ALIAS | CJ-4hr/ LP-4hr | K-50/CK | K-100/CK | Gene Description |
|---|---|---|---|---|---|---|
| 70 | YPL272C | — | 24.778114 | 12.93877 | 11.647985 | Protein of unknown function |
| 71 | YBL100C | — | 4.8456884 | 12.432421 | 16.193059 | Protein of unknown function |
| 72 | YLR024C | — | 11.2130442 | 11.927798 | 17.73046 | Protein with similarity to ubiquitin-protein ligase (E3) UBR1P |
| 73 | YMR102C | — | 4.61311719 | 11.865115 | 16.370862 | — |
| 74 | YGR177C | (ATF2) | 3.7081426 | 11.830169 | 12.555269 | Alcohol O-acetyltransferase |
| 75 | YFR034C | (PHO4) | 14.8112083 | 11.216073 | 20.844515 | Basic helix-loop-helix (BHLH) transcription factor required for expression of phosphate pathway, hyperphosphorylation by PHO80P-PHO85P cyclin-dependent protein kinase complex causes inactivation |
| 76 | YNL282W | — | 5.01708646 | 10.943286 | 13.050614 | — |
| 77 | YPL176C | — | 7.30789994 | 10.664169 | 18.424583 | Protein with similarity to SSP134P |
| 78 | YMR015C | (ERG5) | 10.2651358 | 10.313689 | 9.3557963 | Cytochrome P450 (C-22 sterol desaturase) |
| 79 | YCR061W | — | 4.07462743 | 10.291287 | 12.602668 | Protein of unknown function |
| 80 | YHL030W | (ECM29) | 4.85453872 | 10.275837 | 8.9818305 | Protein possibly involved in cell wall structure or biosynthesis |
| 81 | YPL036W | (PMA2) | 7.19300398 | 10.171951 | 12.917306 | H+-transporting P-type ATPase of the plasma membrane, expression not detected under normal growth conditions |
| 82 | YFR007W | — | 2.58144987 | 10.102403 | 6.0105766 | Protein of unknown function |
| 83 | YOL067C | (RTG1) | 30.4142081 | 10.027065 | 27.36633 | Basic helix-loop-helix (BHLH) transcription factor involved in inter-organelle communication between mitochondria, peroxisomes, and nucleus |
| 84 | YGR265W | — | 22.156977 | 9.9554618 | 5.672919 | Protein of unknown function |
| 85 | YGR293C | — | 51.4998515 | 9.7686634 | 8.066486 | Protein of unknown function |
| 86 | YMR008C | (PLB1) | 5.68517668 | 9.602215 | 11.309345 | Phospholipase B (lysophospholipase), releases fatty acids from lysophospholipids |
| 87 | YOR140W | — | 6.33829162 | 9.2015298 | 12.881145 | — |
| 88 | YML034W | — | 4.44092944 | 9.2011248 | 15.848216 | Protein of unknown function |
| 89 | YGR176W | — | 4.56487981 | 8.8866015 | 12.598661 | Protein of unknown function |
| 90 | YOR014W | (RTS1) | 7.03478812 | 8.8422619 | 11.590438 | Protein serine/threonine phosphatase 2A (PP2A), B' regulatory subunit, involved in regulation of stress-related responses and the cell cycle |
| 91 | YMR317W | — | 25.9636363 | 8.6834125 | 11.973301 | Protein of unknown function |
| 92 | YOR301W | — | 11.3702021 | 8.6327901 | 13.589223 | Protein of unknown function |
| 93 | YER119C-A | — | 8.9509545 | 8.4086333 | 6.8517264 | — |
| 94 | YOR385W | — | 6.30021483 | 8.3714543 | 10.537348 | Protein of unknown function |
| 95 | YGL156W | (AMS1) | 11.9450551 | 8.2732125 | 9.9190578 | Alpha-mannosidase, hydrolyzes terminal non-reducing alpha-D-mannose residues from alpha-D-mannosides |
| 96 | YJL219W | (HXT9) | 6.10093958 | 8.1969449 | 14.860533 | Hexose transporter, member of the sugar permease family |
| 97 | YFL053W | — | 3.55404282 | 8.1217569 | 6.04425 | — |
| 98 | YNL279W | — | 2.75618909 | 8.0041323 | 12.470971 | Protein of unknown function |
| 99 | YHR007C | (ERG11) | 5.511691 | 7.8623796 | 8.6320676 | Cytochrome P450 (lanosterol I4alpha-demethylase), essential for biosynthesis of ergosterol |
| 100 | YJL127C | (SPT10) | 4.01528284 | 7.8394427 | 10.096027 | Protein that amplifies the magnitude of transcriptional regulation at various loci |
| 101 | YPL044C | — | 2.61973879 | 7.8291062 | 4.5399013 | Protein of unknown function |
| 102 | YOR030W | (DFG16) | 4.97362211 | 7.8182123 | 10.573213 | Protein involved in invasive growth upon nitrogen starvation |
| 103 | YIL011W | — | 4.59710634 | 7.3954743 | 6.7112038 | Protein with similarity to YIL176P. YIR041P and other members of the PAU1 family |
| 104 | YNR069C | — | 14.3161508 | 7.3694614 | 14.104044 | Protein of unknown function |
| 105 | YNL083W | — | 2.06305137 | 7.3050052 | 15.674556 | Protein of the mitochondrial carrier (MCF) family |
| 106 | YJL020C | — | 6.76775321 | 7.0352757 | 5.3432583 | Protein of unknown function |
| 107 | YFL065C | — | 13.5712126 | 7.0075571 | 16.704839 | Protein with similarity to other subtelomerically-encoded proteins including YHL049P, YIL177P, YJL225P, YER190P, YHR218P, and YEL076P |
| 108 | YNL329C | (PAS8) | 3.75487269 | 6.7699941 | 25.980939 | — |
| 109 | YHR006W | (STP2) | 6.44648003 | 6.5480808 | 9.270283 | Protein involved in TRNA splicing and branched-chain amino acid uptake |
| 110 | YJL221C | (FSP2) | 2.37104879 | 6.4365653 | 6.3055084 | Protein with similarity to alpha-D-glucosidase (maltase) (FSP2 and YIL172C code for identical proteins) (YIL172C and YGR287C are nearly identical) |

TABLE 2*-continued

| Seq. Num. | Clone ID | ALIAS | CJ-4hr/ LP-4hr | K-50/CK | K-100/CK | Gene Description |
|---|---|---|---|---|---|---|
| 111 | YMR037C | (MSN2) | 6.80686734 | 6.4235969 | 7.6612989 | Zinc-finger transcriptional activator for genes involved in the multistress response and genes regulated through SNF1P |
| 112 | YLR379W | — | 6.34038543 | 6.4227358 | 6.8206953 | Protein of unknown function |
| 113 | YLR056W | (ERG3) | 0.03858406 | 6.2735601 | 5.191422 | C-5 sterol desaturase, an iron non-heme oxygen-requiring enzyme of the ergosterol biosynthesis pathway |
| 114 | YMR319C | (FET4) | 3.5515443 | 0.2641804 | 8.194608 | Low-affinity Fe(II) transport protein |
| 115 | YBR045C | (GIP1) | 5.88011982 | 6.254107 | 3.8135044 | GLC7P-interacting protein, possible regulatory subunit for the PP1 family protein phosphatases GLC7P |
| 116 | YKL147C | — | 4.54862611 | 6.2431328 | 10.034699 | Protein of unknown function |
| 117 | YMR135W-A | — | 15.3287997 | 6.1049555 | 4.611173 | — |
| 118 | YCR048W | (ARE1) | 9.11370518 | 6.1039374 | 10.531291 | Acyl-COA:sterol acyltransferase (sterol-ester synthetase) |
| 119 | YBR235W | — | 2.65851474 | 6.1026186 | 2.9854465 | Protein with similarity to human SLC12A1 gene for which mutations are the cause of Bartier's Syndrome |
| 120 | YJL160C | — | 5.14571281 | 6.0795621 | 6.0193217 | Protein with similarity to members of the PIR1P/HSP150P/PIR3P family |
| 121 | YNL287W | (SEC21) | 5.55890054 | 6.0742978 | 5.8985117 | Coatomer complex gamma chain (gamma-COP) of secretory pathway vesicles, required for retrograde Golgi to endoplasmic reticulum transport |
| 122 | YLR458W | — | 28.2501296 | 5.9435623 | 4.6311951 | — |
| 123 | YLR121C | — | 4.04284936 | 5.9154936 | 8.131848 | — |
| 124 | YLR347C | (KAP95) | 3.84797845 | 5.8759152 | 6.4154978 | Karyopherin-beta, acts to target proteins with nuclear localization (NLS) sequences to the nuclear pore complex |
| 125 | YDL023C | — | 3.26329833 | 5.8589624 | 4.7058193 | Protein of unknown function |
| 126 | YAL010C | (MDM10) | 5.34077952 | 5.807758 | 8.9195451 | Protein involved in mitochondrial morphology and inheritance, mutant has large spherical mitochondria that do not move into the bud |
| 127 | YDR077W | (SED1) | 3.30340602 | 5.6959082 | 5.9206909 | Abundant cell surface glycoprotein, overexpression suppresses growth defect of ERD2 |
| 128 | YDR247W | — | 3.28497642 | 5.6793015 | 6.7651448 | Serine/threonine protein kinase with similarity of S. pombe RAN1 negative regulator of sexual conjugation and meiosis (GB:Z49701) |
| 129 | YBL011W | — | 3.59243122 | 5.650363 | 8.393684 | — |
| 130 | YDL025C | — | 2.91426204 | 5.5604876 | 3.9241843 | Serine/threonine protein kinase with similarity to members of the NPR1 subfamily |
| 131 | YAL013W | (DEP1) | 8.79366086 | 5.5463386 | 6.42501 | Regulator of phospholipid metabolism |
| 132 | YIL084C | (SDS3) | 1.99582364 | 5.5430688 | 6.9074225 | Suppressor of silencing defect |
| 133 | YJL213W | — | 7.09632444 | 5.4980741 | 5.5079382 | Protein with weak similarity to nocardia aryldialkylphosphatase |
| 134 | YKR053C | — | 5.37724431 | 5.4952302 | 6.4562635 | — |
| 135 | YNR042W | — | 17.7115615 | 5.4798109 | 7.5527661 | Protein of unknown function |
| 136 | YCR072C | — | 5.34712592 | 5.4565375 | 4.5985045 | Protein with similarity to nuclear MRNA processing protein PRP4P, member of WD (WD-40) repeat family |
| 137 | YER086W | (ILV1) | 4.55278717 | 5.4449008 | 4.2437712 | Serine and threonine dehydratase (anabolic), first step in isoleucine biosynthesis pathway |
| 138 | YJL076W | — | 11.4128793 | 5.4277219 | 6.6898119 | — |
| 139 | YLR072W | — | 5.19287856 | 5.4152299 | 7.2827024 | Protein of unknown function |
| 140 | YDR301W | (YHH1) | 2.51614995 | 5.4121298 | 7.0975432 | — |
| 141 | YIL055C | — | 2.0005314 | 5.3410327 | 4.6542324 | Protein of unknown function |
| 142 | YEL076W-C | — | 13.2032684 | 5.3265661 | 8.0731692 | — |
| 143 | YNR047W | — | 4.44731559 | 5.3217828 | 6.1790659 | Serine/threonine protein kinase of unknown function |
| 144 | YGL211W | — | 4.00934024 | 5.2957602 | 5.5379668 | Protein of unknown function |
| 145 | YGL012W | (ERG4) | 4.57738431 | 5.2945042 | 4.833773 | Sterol C-24 reductase |
| 146 | YCL014W | (BUD3) | 2.0970839 | 5.2855114 | 3.3963317 | Protein localized at the neck filament ring required for axial budding, may provide a memory of the previous bud site |
| 147 | YBR106W | — | 5.74228482 | 5.2537051 | 9.2061479 | — |
| 148 | YHR095W | — | 5.25923706 | 5.2434619 | 2.2666062 | Protein of unknown function |
| 149 | YEL010W | — | 3.39547744 | 5.2424909 | 3.9026395 | Protein of unknown function |
| 150 | YBR005W | — | 5.58242328 | 5.2283592 | 7.5591013 | Protein of unknown function |
| 151 | YPL183C | — | 3.25331232 | 5.2150911 | 4.034456 | Protein of unknown function, has WD (WD-40) repeats |
| 152 | YJL159W | — | 5.95901062 | 5.2095163 | 5.0420867 | — |
| 153 | YBL065W | — | 5.04084137 | 5.1918263 | 10.287249 | Protein of unknown function |
| 154 | YDL071C | — | 7.24874297 | 5.1844239 | 7.5184825 | Protein of unknown function |

TABLE 2*-continued

| Seq. Num. | Clone ID | ALIAS | CJ-4hr/ LP-4hr | K-50/CK | K-100/CK | Gene Description |
|---|---|---|---|---|---|---|
| 155 | YGR197C | (SNG1) | 6.43784806 | 5.17339 | 7.8870948 | Probable transport protein that confers resistance to MNNG and nitrosoguanidine |
| 156 | YLL028W | — | 9.27382002 | 5.0519624 | 5.3421753 | Member of major facilitator superfamily (MFS) multidrug-resistance (MFS-MDR) protein family |
| 157 | YKR034W | (DAL80) | 3.91750209 | 5.0436172 | 7.2838566 | GATA-type zinc finger transcriptional repressor for allantoin and 4-aminobutyric acid (GABA) catabolic genes |
| 158 | YDR430C | — | 2.19022255 | 5.0401778 | 3.1989703 | Protein with similarity to Class 1 family of aminoacyl-TRNA synthetases |
| 159 | YPL274W | — | 5.4156341 | 5.0164198 | 6.1307085 | Protein with similarity to GAP1P and other amino acid permeases |
| 160 | YMR261C | (TPS3) | 3.96385669 | 4.94376 | 3.7501015 | Component of the trehalose-6-phosphate synthase/phosphatase complex, alternate third subunit with TLS1P |
| 161 | YOL118C | — | 3.20265396 | 4.936553 | 5.7544219 | Protein of unknown function |
| 162 | YOR005C | (DNL4) | 4.47086248 | 4.8815521 | 3.6707508 | ATP-dependent DNA ligase IV, involved in non-homologous DNA end joining |
| 163 | YNL332W | — | 3.33896215 | 4.8789948 | 4.7570682 | — |
| 164 | YDR069C | (DOA4) | 3.37810593 | 4.8769723 | 5.1947947 | Ubiquitin-specific protease (ubiquitin C-terminal hydrolase) of the 26S proteasome complex, involved in vacuole biogenesis and osmoregulation |
| 165 | YOR009W | — | 59.4543494 | 4.8708102 | 5.2948993 | Protein with similarity to members of the PAU1 family |
| 166 | YMR035W | (IMP2) | 9.23409301 | 4.8492871 | 5.7664813 | Inner membrane protease of mitochondria, acts in complex with IMP1P but has different substrate specificity for removal of signal peptidase |
| 167 | YER089C | (PTC2) | 2.23920866 | 4.8455014 | 5.8687657 | Protein serine/threonine phosphatase of the PP2C family |
| 168 | YJR018W | — | 5.54754057 | 4.8389334 | 4.4934937 | Protein of unknown function |
| 169 | YLR088W | (GAA1) | 3.1893544 | 4.814116 | 4.0142997 | Protein required for attachment of GPI anchor onto proteins, affects endocytosis |
| 170 | YOL163W | — | 3.92239312 | 4.8014959 | 4.5124682 | Protein with weak similarity to pseudomonas putida phthalate transporter |
| 171 | YLR462W | — | 3.32915042 | 4.7928645 | 7.1350658 | Protein of unknown function |
| 172 | YLR098C | (CHA4) | 2.05280928 | 4.7564347 | 5.5866465 | Zinc-finger protein required for activation of CHA1, has A ZN[2]-CYS[6] fungal-type binuclear cluster domain |
| 173 | YNR053C | — | 2.55991235 | 4.7234659 | 3.8186389 | Protein with similarity to human breast tumor-associated autoantigen |
| 174 | YDL246C | — | 2.43826188 | 4.6757263 | 3.5757353 | Protein with similarity to SOR1P (SOR1 and YDL246C code for nearly identical proteins) |
| 175 | YOL045W | — | 3.55662236 | 4.672513 | 2.0538279 | Serine/threonine protein kinase of unknown function |
| 176 | YKL176C | — | 3.32695888 | 4.6429893 | 5.4538239 | Protein of unknown function |
| 177 | YJR114W | — | 3.00664482 | 4.6389866 | 4.0045917 | Protein of unknown function |
| 178 | YER091C | (MET6) | 6.67067887 | 4.6224571 | 2.9292597 | Homocysteine methyltransferase (5-methyltetraydropteroyl triglutamate-homocysteine methyltransferase), methionine synthase, cobalamin-independent |
| 179 | YHL049C | — | 5.15537247 | 4.5637645 | 9.5066446 | Protein with similarity to other subtelomerically-encoded proteins including YER189P, YML133P, and YJL225P, coded from a subtelomeric Y' region |
| 180 | YDR389W | (SAC7) | 3.89197011 | 4.5609599 | 4.3143109 | GTPase-activating protein for RHO1P |
| 181 | YMR202W | (ERG2) | 9.58572292 | 4.5446614 | 5.575174 | Sterol C8–C7 isomerase (C-8 sterol isomerase), enzyme of the ergosterol biosynthesis pathway |
| 182 | YBL019W | — | 3.45990928 | 4.4694518 | 4.1655454 | — |
| 183 | YGR287C | — | 10.2933872 | 4.4595137 | 9.7718104 | Protein with similarity to alpha-D-glucosidase (maltase) (YGR287CIS nearly identical to FSP2 and YIL172C) |
| 184 | YJL082W | — | 7.42175571 | 4.4522595 | 5.556901 | Protein of unknown function |
| 185 | YHR098C | — | 2.51284975 | 4.4353768 | 4.3716652 | Protein of unknown function |
| 186 | YOR371C | — | 2.47743776 | 4.4289864 | 5.2783501 | Protein of unknown function |
| 187 | YDR530C | (APA2) | 2.40849553 | 4.3993312 | 2.7389073 | ATP adenylyltransferase II (AP4A phosphorylase) |
| 188 | YKL119C | (VPH2) | 0.16462534 | 4.3613346 | 0 | Vacuolar H-ATPase (V-ATPase) assembly protein acting in the endoplasmic reticulum |
| 189 | YOR273C | — | 13.0544715 | 4.3469302 | 10.649131 | Protein with similarity to members of major facilitator superfamily (MFS) multidrug-resistance (MFS-MDR) protein family |

TABLE 2*-continued

| Seq. Num. | Clone ID | ALIAS | CJ-4hr/ LP-4hr | K-50/CK | K-100/CK | Gene Description |
|---|---|---|---|---|---|---|
| 190 | YPL042C | (SSN3) | 6.78272968 | 4.3344728 | 3.9578568 | Cyclin-dependent serine/threonine protein kinase of the RNA polymerase II holoenzyme complex and Kornberg's mediator (SRB) subcomplex |
| 191 | YGR268C | — | 4.77373538 | 4.3329069 | 5.2744105 | Protein of unknown function |
| 192 | YPR011C | — | 2.0077462 | 4.3123349 | 4.2742986 | Protein with similarity to human Grave's Disease carrier protein (SP:P16260) and to bovine homolog of Grave's Disease carrier protein (SP:Q01888) |
| 193 | YPL022W | (RAD1) | 4.48327554 | 4.3036056 | 6.5285426 | Component of the nucleotide excision repairosome, homolog of human XPF xeroderma pigmentosum gene product and the mammalian ERCC-4 protein |
| 194 | YGL207W | (SPT16) | 5.34289635 | 4.3033021 | 3.5727713 | General chromatin factor required for adequate expression of CLN and other genes |
| 195 | YGL167C | (PMR1) | 4.12359747 | 4.2628564 | 4.8141347 | CA++-transporting P-type ATPase of Golgi membrane involved in CA++ import into Golgi |
| 196 | YJR091C | (JSN1) | 4.56429439 | 4.2419881 | 4.7804157 | Protein that when overexpressed can suppress the hyperstable microtubule phenotype of TUB2-150 |
| 197 | YDR238C | (SEC26) | 4.48641405 | 4.2179222 | 3.8109695 | Coatomer complex beta chain (beta-COP) of secretory pathway vesicles, required for retrograde transport from Golgi to endoplasmic reticulum |
| 198 | YDL012C | — | 2.90930997 | 4.2158147 | 2.0519798 | Protein of unknown function |
| 199 | YDR044W | (HEM13) | 14.9283272 | 4.2136787 | 3.4946018 | Coproporphyrinogen III oxidase, oxygen-repressed, sixth step in heme-biosynthetic pathway |
| 200 | YGL114W | — | 3.22707938 | 4.2023503 | 5.0073787 | Protein with similarity to S. pombe ISP4 protein, member of the major facilitator superfamily (MFS) |
| 201 | YGL055W | (OLE1) | 2.29875509 | 4.1923045 | 3.5992372 | Stearoyl-COA desaturase (delta-9 fatty acid desaturase), required for synthesis of unsaturated fatty acids |
| 202 | YDL088C | (ASM4) | 4.39685251 | 4.1757265 | 3.321034 | Suppressor of temperature-sensitive mutations in POL3P (DNA polymerase delta) |
| 203 | YKL171W | — | 2.64137608 | 4.1581147 | 8.2933538 | Serine/threonine protein kinase of unknown function |
| 204 | YPL190C | — | 5.94196213 | 4.1575162 | 3.202837 | — |
| 205 | YMR140W | — | 5.24432896 | 4.157179 | 5.4545409 | Protein of unknown function |
| 206 | YBL005W | (PDR3) | 3.75060207 | 4.1449054 | 6.0827305 | Transcription factor related to PDR1P, contains a ZN[2]-CYS[6] fungal-type binuclear cluster domain in the N-terminal region |
| 207 | YML032C | (RAD52) | 3.13968668 | 4.1330793 | 3.0832115 | Protein required for recombination and repair of X-ray damage, has a late function in meiotic recombination |
| 208 | YFR018C | — | 5.28886874 | 4.1041589 | 6.4001917 | Protein with similarity to human glutaminyl-peptide cyclotransferase |
| 209 | YGL125W | (MET11) | 6.80542292 | 4.0762178 | 4.4382484 | — |
| 210 | YCR057C | (PWP2) | 3.34704165 | 4.0555292 | 3.4118145 | — |
| 211 | YBL044W | — | 4.67885642 | 4.0526493 | 9.1998322 | Protein of unknown function |
| 212 | YPL268W | (PLC1) | 2.90633764 | 4.0372127 | 2.1993847 | Phosphoinoditide-specific phospholipase C (1-phosphatidylinositol-4,5-bisphosphate phosphodiesterase 1), produces diacylglycerol and inositol 1,4,5-trisphosphate |
| 213 | YOR204W | (DED1) | 2.52920945 | 4.0291663 | 3.0830731 | ATP-dependent RNA helicase of dead box family involved in protein synthesis |
| 214 | YPL171C | (OYE3) | 4.94122983 | 4.0225239 | 0.2747214 | NAPDH dehydrogenase (old yellow enzyme), isoform 3 |
| 215 | YOR203W | — | 3.473713 | 3.9900922 | 3.2232019 | Protein of unknown function |
| 216 | YNL295W | — | 2.855052 | 3.9889367 | 2.1389666 | Protein of unknown function |
| 217 | YEL042W | (GDA1) | 2.00067395 | 3.9856733 | 3.8058139 | Guanosine diphosphatase of Golgi membrane |
| 218 | YLR339C | — | 4.12619065 | 3.9844972 | 3.506939 | Protein of unknown function |
| 219 | YIL007C | — | 5.11957134 | 3.9770005 | 2.318674 | Protein of unknown function |
| 220 | YIR007W | — | 3.71972069 | 3.9670484 | 5.0861072 | Protein with similarity to endoglucanase |
| 221 | YER114C | (BOI2) | 2.5967273 | 3.9643546 | 6.3042836 | Protein with SH3 domain involved in bud formation, binds to BEM1P |
| 222 | YLR092W | (SUL2) | 6.02237117 | 3.9547891 | 4.5438793 | High-affinity sulfate transporter |
| 223 | YEL060C | (PRB1) | 5.60961951 | 3.939317 | 4.7370327 | Protease B (YSCB) (PRB) (cerevisin), serine protease of the subtilisin family with broad proteolytic specificity |

TABLE 2*-continued

| Seq. Num. | Clone ID | ALIAS | CJ-4hr/ LP-4hr | K-50/CK | K-100/CK | Gene Description |
|---|---|---|---|---|---|---|
| 224 | YAL051W | — | 2.40553928 | 3.9334781 | 4.5099518 | — |
| 225 | YJR147W | — | 2.05911726 | 3.9267937 | 5.1956856 | — |
| 226 | YOR386W | (PHR1) | 1.99823774 | 3.9204076 | 5.7090569 | Deoxyribodipyrimidine photolyase, involved in light-dependent repair of pyrimidine dimers |
| 227 | YCR037C | (PHO87) | 2.81200613 | 3.8982171 | 4.0311884 | Member of the phosphate permease family of the major facilitator superfamily |
| 228 | YOL100W | — | 3.04632994 | 3.8854218 | 9.2592192 | Serine/threonine protein kinase of unknown function |
| 229 | YBL047C | — | 3.40597241 | 3.88363 | 5.2814809 | Protein with similarity to cytoskeletal protein USO1P, PAN1P, and mouse tyrosine kinase substrate EPS15 |
| 230 | YAR014C | — | 2.53512963 | 3.823947 | 4.4065791 | Protein of unknown function |
| 231 | YKL182W | (FAS1) | 3.75368336 | 3.8068781 | 5.3493259 | Fatty-acyl-COA synthase, beta chain (contains acetyl transferase, enoyl reductase, dehydratase, and malonyl/palmitoyl transferase) |
| 232 | YLR331C | — | 3.94099666 | 3.795387 | 3.3715843 | Protein of unknown function |
| 233 | YEL031W | (SPF1) | 7.77512435 | 3.7891074 | 4.357615 | Protein with similarity to CA++- transporting ATPases |
| 234 | YHR078W | — | 2.2941334 | 3.7838221 | 4.6151917 | Protein of unknown function, has 4 potential transmembrane domains |
| 235 | YPL155C | (KIP2) | 3.29502679 | 3.7807978 | 9.392792 | Kinesin-related protein |
| 236 | YNR074C | — | 4.3061075 | 3.7638306 | 5.7991531 | Protein with similarity to *Bacillus subtilis* nitrite reductase (NIRB) |
| 237 | YMR303C | (ADH2) | 4.56919214 | 3.7542967 | 3.1957867 | Alcohol dehydrogenase II, glucose-repressed |
| 238 | YLR134W | (PDC5) | 4.9450653 | 3.7528169 | 3.2704832 | Pyruvate decarboxylase isozyme 2 |
| 239 | YKL067W | (YNK1) | 4.49102455 | 3.7325797 | 3.6497934 | Nucleoside diphosphate kinase, responsible for synthesis of all nucleoside triphosphates except ATP |
| 240 | YLR136C | (TIS11) | 2.88004451 | 3.7255421 | 5.1711798 | — |
| 241 | YDR443C | (SCA1) | 2.75733315 | 3.7068432 | 6.9331513 | — |
| 242 | YGL071W | (RCS1) | 3.39203358 | 3.6963077 | 4.5310166 | Regulatory protein involved in IRON uptake |
| 243 | YBR293W | — | 2.25740646 | 3.6840827 | 3.0384171 | Member of major facilitator superfamily (MFS) multidrug-resistance (MFS-MDR) protein family |
| 244 | YMR324C | — | 3.33053542 | 3.6802526 | 2.8779503 | Protein with similarity to members of the YBL108P/YCR103P/YKL223P family |
| 245 | YFL051C | — | 2.07690974 | 3.6611179 | 4.7476201 | Protein with similarity to FLO1P family of proteins |
| 246 | YBR276C | (PPS1) | 2.35950244 | 3.6550406 | 3.4539593 | Protein tyrosine phosphatase (PTPase) with dual specificity |
| 247 | YFL042C | — | 3.57726533 | 3.6509118 | 4.5694594 | Protein of unknown function, has similarity to YHR080P |
| 248 | YPL203C | (KEL3) | 4.50871509 | 3.6484792 | 3.8498382 | Protein with similarity to KEL1P and KEL2P |
| 249 | YLR188W | (MDL1) | 5.00498919 | 3.6475982 | 4.3936321 | ATP-binding cassette (ABC) superfamily member, equivalent to a "half-molecule" ABC protein plus an ATP-binding domain |
| 250 | YPR021C | — | 2.21061647 | 3.6466639 | 3.2312479 | Protein with similarity to proteins of the mitochondrial carrier (MCF) family (GB:Z49274) |
| 251 | YKL138C | (MRPL31) | 3.22538649 | 3.6454084 | 4.0488722 | Mitochondrial ribosomal protein of the large subunit (YML31) |
| 252 | YNL148C | (ALF1) | 3.33997835 | 3.6391378 | 5.2515594 | Alpha-tubulin foldin, cofactor B |
| 253 | YLR302C | — | 10.5636377 | 3.6318383 | 0.3621924 | Protein of unknown function |
| 254 | YBR298C | (MAL31) | 5.44502575 | 3.6302693 | 9.8311328 | High affinity maltoaseH+ symporter (maltose permease) member of the sugar permease family |
| 255 | YAR044W | (OSH1) | 4.12112011 | 3.624939 | 3.8839622 | Protein implicated in ergosterol biosynthesis, member of the KES1/HES1/OSH1/YKR003W family of oxysterol-binding (OSBP) proteins |
| 256 | YLR120C | (YAP3) | 6.14265883 | 3.6229845 | 4.4298562 | Transcription factor of the basic leucine zipper (BZIP) family, one of eight members of a novel fungal-specific family of BZIP proteins |
| 257 | YGR134W | — | 2.8756723 | 3.6189405 | 1.9505784 | Protein of unknown function |
| 258 | YMR088C | — | 3.01763425 | 3.574571 | 2.5742717 | Member of major facilitator superfamily (MFS) multidrug-resistance (MFS-MDR) protein family 2 |
| 259 | YDR291W | — | 4.95353348 | 3.5637613 | 2.8803997 | Protein with similarity to SGS1P and other DNA helicases |
| 260 | YJR017C | (ESS1) | 2.98118086 | 3.5587415 | 3.2208256 | Processing/termination factor, involved in transcription termination or 3'-end processing of pre-MRNA |
| 261 | YGL178W | (MPT5) | 4.28561965 | 3.558276 | 3.3338238 | Protein required for high temperature growth, recovery from alpha-factor arrest, and normal lifespan of yeast cells |

TABLE 2*-continued

| Seq. Num. | Clone ID | ALIAS | CJ-4hr/ LP-4hr | K-50/CK | K-100/CK | Gene Description |
|---|---|---|---|---|---|---|
| 262 | YHR086W | (NAM8) | 2.63503306 | 3.556686 | 4.1441189 | U1 SNRNA-associated protein, essential for meiotic recombination and suppressor of mitochondrial splicing defects, has 3 RNA recognition (RRM) domains |
| 263 | YGR178C | (PBP1) | 2.95926792 | 3.5559294 | 3.6095103 | poly(A)-binding protein |
| 264 | YBL022C | (PIM1) | 4.1993836 | 3.5255118 | 3.2518435 | Serine protease required for intramitochondrial proteolysis and maintenance of respiratory function, related to E. coli ATP-dependent protease LA |
| 265 | YJL083W | — | 3.34026267 | 3.5131828 | 5.6812601 | Protein with similarity to IRS4P |
| 266 | YJR053W | — | 2.12253894 | 3.5096202 | 4.5401439 | Protein involved in efficiency of mating |
| 267 | YJL175W | — | 6.11781731 | 3.5040684 | 3.7938536 | Protein of unknown function |
| 268 | YMR016C | — | 3.67893179 | 3.4720987 | 3.3111279 | — |
| 269 | YLL051C | (FRE6) | 2.59520796 | 3.4643555 | 4.4566151 | Protein with similarity to ferric reductase FRE2P |
| 270 | YJL212C | — | 4.42206996 | 3.458335 | 4.0764022 | Protein with similarity to S. pombe ISP4+ which is induced by sexual differentiation |
| 271 | YMR019W | (STB4) | 3.2576922 | 3.4414621 | 3.397646 | SIN3P-binding protein, has ZN[2]-CYS[6] fungal-type binuclear cluster domain in the N-terminal region |
| 272 | YHL047C | — | 3.02606918 | 3.4089434 | 3.007093 | Member of major facilitator superfamily (MFS) multidrug-resistance (MFS-MDR) protein family |
| 273 | YBR038W | (CHS2) | 2.03060756 | 3.3885338 | 2.8509884 | Chitin synthase II, responsible for primary septum disk |
| 274 | YLR023C | — | 2.68880866 | 3.3876183 | 2.5555381 | Protein of unknown function |
| 275 | YPL009C | — | 5.28314415 | 3.3856037 | 0.8412905 | Protein of unknown function |
| 276 | YGL008C | (PMA1) | 2.09210526 | 3.3844005 | 3.725269 | H+-transporting P-type ATPase of the plasma membrane, activity is rate-limiting for growth at low pH |
| 277 | YMR033W | (ARP9) | 3.08586194 | 3.3800103 | 2.9005564 | Protein with similarity to actin and actin-related proteins ARP1P–ARP10P |
| 278 | YLR153C | (ACS2) | 3.45528019 | 3.3785446 | 3.1285812 | Acetyl-COA synthetase (acetate-COA ligase) |
| 279 | YLL061W | — | 10.9366799 | 3.369477 | 3.0795633 | Protein with similarity to GAP1P and other amino acid permeases |
| 280 | YNL192W | (CHS1) | 3.72575719 | 3.358192 | 3.7457248 | Chitin synthase I, has a repair function during cell separation |
| 281 | YEL058W | (PCM1) | 4.56623631 | 3.3482618 | 3.4456437 | Hexosephosphate mutase (phosphoacetylglucosamine mutase) (N-acetylglucosaminephosphate mutase), converts N-acetyl-D-glucosamine 1-phosphate to N-acetyl-D-glucosamine 6-phosphate |
| 282 | YLR099C | — | 4.72209646 | 3.3290462 | 2.9774757 | Protein of unknown function |
| 283 | YDL057W | — | 3.21787484 | 3.316811 | 4.4492894 | Protein of unknown function |
| 284 | YLR195C | (NMT1) | 3.4535546 | 3.3142347 | 3.1727409 | N-myristoyltransferase, adds myristoyl group to N-terminal glycine of certain proteins |
| 285 | YAL005C | (SSA1) | 3.48582964 | 3.3068323 | 2.9388227 | Heat shock protein of HSP70 family, cytoplasmic |
| 286 | YPL222W | — | 2.79485782 | 3.2974442 | 2.9997551 | Protein of unknown function |
| 287 | YJL056C | — | 2.36206747 | 3.2790296 | 3.3129634 | — |
| 288 | YKR021W | — | 2.33705924 | 3.269552 | 2.936447 | Protein of unknown function |
| 289 | YPL119C | (DBP1) | 5.87199247 | 3.2464223 | 2.197366 | ATP-dependent RNA helicase of dead box family, suppressor SPPS1/DED1 |
| 290 | YGL014W | — | 3.11296478 | 3.2294295 | 3.6382821 | Protein with pumilio repeats that is involved with MPT5P in relocalization of SIR3P and SIR4P from telomeres to the nucleolus |
| 291 | YER010C | — | 11.4713039 | 3.2179542 | 2.3807886 | Protein of unknown function |
| 292 | YJR151C | — | 41.4229667 | 3.2130608 | 4.5216913 | Protein of unknown function |
| 293 | YPL207W | — | 2.48831068 | 3.2080219 | 2.9864022 | Protein of unknown function |
| 294 | YER130C | — | 2.01652303 | 3.2075344 | 3.3332725 | Protein of unknown function |
| 295 | YNR065C | — | 2.86361451 | 3.2060768 | 7.3945002 | Protein with similarity to PEP1P |
| 296 | YGL192W | (IME4) | 2.89030953 | 3.170381 | 6.4784105 | Positive transcription factor for IME1 and IME2, mediates control of meiosis by carrying signals regarding mating type (A/alpha) and nutritional status |
| 297 | YMR047C | (NUP116) | 2.56622055 | 3.1702234 | 4.7742052 | Nuclear pore protein (nucleopurin) of the GLFG family, may be involved in binding and translocation of nuclear proteins |
| 298 | YDR256C | (CTA1) | 4.54027942 | 3.158248 | 8.0093186 | Catalase A (peroxisomal) |
| 299 | YDR208W | (MSS4) | 2.61164524 | 3.154316 | 3.0423151 | Potential PI P 5-kinase, multicopy suppressor of STT4 mutation |

TABLE 2*-continued

| Seq. Num. | Clone ID | ALIAS | CJ-4hr/ LP-4hr | K-50/CK | K-100/CK | Gene Description |
|---|---|---|---|---|---|---|
| 300 | YHR214W | — | 4.54013428 | 3.1513793 | 5.6325011 | Protein of unknown function (YAR066W and YHR214W code for identical proteins) |
| 301 | YLR249W | (YEF3) | 3.59397167 | 3.1445334 | 2.631954 | Translation elongation factor EF-3A, member of ATP-binding cassette (ABC) superfamily |
| 302 | YNL331C | — | 3.44801501 | 3.1185277 | 6.5303136 | Probable aryl-alcohol reductase |
| 303 | YPR115W | — | 2.4843458 | 3.1174643 | 2.5667848 | Protein of unknown function |
| 304 | YJL178C | — | 2.60257256 | 3.1121969 | 2.7705734 | Protein of unknown function |
| 305 | YAR042W | (SWH1) | 18.1940127 | 3.0992362 | 6.2488302 | Protein of unknown function |
| 306 | YDR015C | — | 0.09079169 | 3.0861607 | 0.3097629 | Protein of unknown function |
| 307 | YBL067C | (UBP13) | 3.41427731 | 3.0820393 | 2.4717411 | Ubiquitin C-terminal hydrolase |
| 308 | YHR072W | (ERG7) | 3.5569619 | 3.0809956 | 3.4311189 | Lanosterol synthase, carries out complex cyclization step of squalene to lanosterol in ergosterol biosynthesis pathway |
| 309 | YAL028W | — | 9.17485562 | 3.0726043 | 3.8109858 | Protein of unknown function |
| 310 | YIR015W | — | 2.80351347 | 3.066482 | 3.4328314 | Subunit of RNase P |
| 311 | YMR308C | (PSE1) | 2.69422447 | 3.0659484 | 2.6409014 | — |
| 312 | YOR345C | — | 5.73841888 | 3.0523183 | 2.2898958 | Deoxycytidyl transferase involved in mutagenic translesion DNA synthesis |
| 313 | YPL193W | — | 3.60415592 | 3.0500696 | 2.8450987 | Protein of unknown function |
| 314 | YFR012W | — | 3.31259823 | 3.0316711 | 0 | Protein of unknown function |
| 315 | YPL205C | — | 13.258257 | 3.0208358 | 0.7999155 | Protein of unknown function |
| 316 | YDR476C | — | 8.1273943 | 3.0155987 | 3.8636781 | Protein of unknown function |
| 317 | YCR052W | (RSC6) | 2.2744649 | 3.0112438 | 2.6017436 | Component of abundant chromatin remodeling complex (RSC) |
| 318 | YGL022W | (STT3) | 3.64275733 | 3.0050118 | 3.8854905 | Oligosaccharyltransferase subunit, member of a complex of eight ER proteins that transfers core oligosaccharide from dolichol carrier to Asn-X-Ser/Thr motif |
| 319 | YMR109W | — | 19.0544656 | 3.0044499 | 5.6886658 | — |
| 320 | YHR032W | — | 9.30722933 | 2.9855823 | 4.5560581 | Protein of unknown function, member of the major facilitator superfamily (MFS) |
| 321 | YLR236C | — | 2.6190617 | 2.9810987 | 3.7681402 | — |
| 322 | YOR337W | (TEA1) | 2.13152473 | 2.9790715 | 4.8228581 | TY1 enhancer activator of the GAL4P-type family of DNA-binding proteins |
| 323 | YFR055W | — | 2.35867872 | 2.9771983 | 3.0622139 | Protein with similarity to E. coli cystathionine beta-lyase |
| 324 | YHR212C | — | 4.01639255 | 2.9769438 | 4.4451423 | Protein identical to YAR060P/RAA19P |
| 325 | YLR001C | — | 2.77031036 | 2.9663037 | 2.7628132 | Protein of unknown function |
| 326 | YOR034C | — | 3.38439363 | 2.9543526 | 2.5499862 | — |
| 327 | YPR076W | — | 3.86182393 | 2.9410933 | 3.2728075 | Protein of unknown function |
| 328 | YKL183W | — | 2.9718977 | 2.9334031 | 5.2561547 | Protein of unknown function |
| 329 | YBR004C | — | 3.05485559 | 2.9257736 | 2.8905869 | Protein expressed between 3 and 6 hours after transfer to sporulation medium |
| 330 | YJR071W | — | 3.39019477 | 2.924417 | 1.768982 | Protein of unknown function |
| 331 | YCR084C | (TUP1) | 2.40138822 | 2.9219843 | 3.2718264 | General repressor of transcription (with SSN6P), member of WD (WD-40) repeat family |
| 332 | YFR030W | (MET10) | 33.6060485 | 2.9138815 | 2.0879079 | Assimilatory sulfite reductase subunit, flavin-binding (alpha) subunit, part of the sulfate assimilation pathway |
| 333 | YKL148C | (SDH1) | 2.72554507 | 2.9036242 | 2.5317298 | Succinate dehydrogenase (ubiquinone) flavoprotein (FP) subunit, converts succinate + ubiquinone to fumarate + ubiquinol in the TCA cycle |
| 334 | YER044C | — | 3.6669641 | 2.9002716 | 2.6807728 | Protein of unknown function |
| 335 | YLR045C | (STU2) | 2.16969039 | 2.8946579 | 2.9923107 | Component of the spindle pole body |
| 336 | YPL226W | — | 2.45263084 | 2.8885678 | 2.5557944 | Protein with similarity to members of the ATP-binding cassette (ABC) superfamily |
| 337 | YHR161C | — | 2.86345744 | 2.8873374 | 2.9469349 | — |
| 338 | YJR109C | (CPA2) | 4.31426739 | 2.8803515 | 3.1263529 | Carbamoylphosphate synthase (glutamine-hydrolyzing) arginine-specific, large chain |
| 339 | YGR250C | — | 2.20914388 | 2.8752914 | 3.8774955 | Protein of unknown function, has three RNA recognition (RRM) domains |
| 340 | YLR149C | — | 3.39994503 | 2.8694003 | 4.6627573 | Protein of unknown function |
| 341 | YCL057W | (PRD1) | 3.49569406 | 2.8641379 | 2.7495149 | Proteinase YSCD, saccharolysin, contains zinc metalloendoprotease motif HEXXH |
| 342 | YLR114C | — | 2.27233205 | 2.8496505 | 1.8650501 | Protein with weak similarity in the C-terminus to drosophila melanogaster bicaudal-D protein |
| 343 | YML075C | (HMG1) | 2.71708812 | 2.8491957 | 3.2059005 | 3-hydroxy-3-methylglutaryl-coenzyme A reductase 1, rate limiting enzyme for sterol biosynthesis, converts HMG-COA to mevalonate |

TABLE 2*-continued

| Seq. Num. | Clone ID | ALIAS | CJ-4hr/ LP-4hr | K-50/CK | K-100/CK | Gene Description |
|---|---|---|---|---|---|---|
| 344 | YLR397C | (AFG2) | 2.56801854 | 2.8469125 | 2.7385515 | Protein of the AAA family of ATPases, has similarity to mammalian valosin-containing protein (VCP) |
| 345 | YJR019C | (TES1) | 4.07777555 | 2.8303235 | 2.0724897 | Acyl-COA thioesterase |
| 346 | YBL008W | (HIR1) | 7.24580603 | 2.8284713 | 2.8866813 | Histone transcription inhibitor, required for periodic repression of 3 of the 4 histone gene loci and for autogenous repression of HTA1–HTB1 locus by H2A and H2B |
| 347 | YGL062W | (PYC1) | 2.649771 | 2.8279558 | 3.1059191 | Pyruvate carboxylase 1, converts pyruvate to oxaloacetate for gluconeogenesis |
| 348 | YPL244C | — | 3.43385233 | 2.8218119 | 3.3274479 | Protein of unknown function |
| 349 | YGL001C | — | 3.91981575 | 2.8214816 | 1.9852785 | Protein with similarity to nocardia SP. cholesterol dehydrogenase |
| 350 | YMR302C | (PRP12) | 2.92335545 | 2.8146501 | 2.7190981 | — |
| 351 | YPL160W | (CDC60) | 2.25327101 | 2.8142723 | 1.7420948 | Leucyl-TRNA synthetase, cytoplasmic |
| 352 | YLL024C | (SSA2) | 4.09160949 | 2.8142088 | 2.4784071 | Heat shock protein of HSP70 family, cytoplasmic |
| 353 | YEL077C | — | 3.20718793 | 2.8098429 | 3.9054119 | — |
| 354 | YMR205C | (PFK2) | 2.27470363 | 2.8050429 | 2.2843952 | Phosphofructokinase beta subunit, part of a complex with PFK1P which carries out key regulatory step in glycolysis |
| 355 | YPL114W | — | 4.16484234 | 2.7962162 | 1.717967 | Protein of unknown function |
| 356 | YPL221W | — | 4.08515832 | 2.7886642 | 3.960997 | Protein of unknown function |
| 357 | YJR137C | (ECM17) | 26.5435466 | 2.787597 | 2.0763181 | Putative sulfite reductase (ferredoxin) |
| 358 | YKL164C | (PIR1) | 2.11125363 | 2.7864791 | 2.3925674 | Protein required for tolerance to heat shock, member of the PIR1P/HSP150P/PIR3P family |
| 359 | YCL037C | (SRO9) | 8.35007693 | 2.7855748 | 2.393588 | Suppressor of YPT6 null and RHO3 mutations |
| 360 | YHR082C | (KSP1) | 2.14499054 | 2.7799591 | 3.4962633 | Serine/threonine kinase that suppresses PRP20 mutant when overproduced |
| 361 | YPR074C | — | 3.19760669 | 2.7711859 | 2.476508 | — |
| 362 | YBR184W | (MEL1) | 5.06354303 | 2.7711448 | 3.5340388 | Alpha-galactosidase (melibiase), converts melibiose into galactose + glucose, converts melibiose to galactose and glucose |
| 363 | YOL157C | — | 2.70064964 | 2.7668777 | 3.6204284 | Probable alpha-glucosidase |
| 364 | YFL066C | — | 2.94443276 | 2.753026 | 3.5848427 | Protein with similarity to other subtelomerically-encoded proteins including YIL177P, YHL050P, and YER190P |
| 365 | YLL029W | — | 2.22657399 | 2.7389102 | 3.1468025 | Protein of unknown function |
| 366 | YJL198W | — | 2.98124683 | 2.7343513 | 4.6395823 | Protein with strong similarity to PHO87P, member of the phosphate permease family of the major facilitator, superfamily (MFS) |
| 367 | YDR088C | (SLU7) | 2.07293165 | 2.7339627 | 2.6876744 | Pre-MRNA splicing factor affecting 3' splice site choice, required only for the second catalytic step of splicing |
| 368 | YJR132W | (NMD5) | 3.2005363 | 2.7333821 | 3.208398 | Member of the karyopherin-beta family, possibly involved in nuclear transport |
| 369 | YIL078W | (THS1) | 3.31778832 | 2.7330794 | 1.6123939 | Threonyl-TRNA synthetase, cytoplasmic, member of Class II family of aminoacyl-TRNA synthetases |
| 370 | YGL113W | — | 2.33404789 | 2.7249323 | 3.3810122 | Protein of unknown function |
| 371 | YMR086W | — | 2.69384376 | 2.7191747 | 2.9840404 | Protein of unknown function |
| 372 | YGL233W | (SEC15) | 2.61433498 | 2.7141295 | 2.7961427 | Component of exocyst complex required for exocytosis |
| 373 | YGL144C | — | 2.26752066 | 2.7069494 | 2.6236889 | Protein of unknown function |
| 374 | YOR137C | — | 3.14249753 | 2.7031211 | 4.9526236 | Protein of unknown function |
| 375 | YJR143C | (PMT4) | 2.80130312 | 2.6954799 | 2.4879264 | Mannosyltransferase (dolichyl phosphate-D-mannose:protein O-D-mannosyltransferase), involved in initiation of O-glycosylation |
| 376 | YBR289W | (SNF5) | 2.00671327 | 2.6881295 | 3.038619 | Component of SWI/SNF global transcription activator complex, acts to assist gene-specific activators through chromatin remodeling |
| 377 | YNL240C | — | 5.13894557 | 2.685901 | 3.523963 | Protein with similarity to kluyveromyces MARX, LET1 protein |
| 378 | YML013W | — | 3.62672833 | 2.6831604 | 2.9292996 | Protein of unknown function |
| 379 | YKL168C | — | 2.43589311 | 2.6791837 | 3.1896257 | — |
| 380 | YGL151W | (NUT1) | 2.47823061 | 2.6787971 | 2.5683618 | Protein that affects expression of HO |
| 381 | YNL197C | (WHI3) | 2.51493336 | 2.6764555 | 3.4233233 | Protein involved in regulation of cell size, has 1 RNA recognition (RRM) domain |
| 382 | YMR192W | — | 2.18376269 | 2.6732126 | 2.7489187 | Protein with similarity to mouse TBC1 protein |
| 383 | YAL038W | (CDC19) | 2.63679951 | 2.6714535 | 2.7525692 | — |
| 384 | YEL075C | — | 5.12225893 | 2.6632638 | 3.778537 | Protein with similarity to other subtelomerically-encoded proteins including YHL049P, YIL177P, and YJL225P |

TABLE 2*-continued

| Seq. Num. | Clone ID | ALIAS | CJ-4hr/ LP-4hr | K-50/CK | K-100/CK | Gene Description |
|---|---|---|---|---|---|---|
| 385 | YHR219W | — | 3.76398139 | 2.6619567 | 4.0207342 | Protein with similarity to other subtelomerically-encoded proteins |
| 386 | YJL069C | — | 2.65731007 | 2.6517254 | 2.6568606 | Protein of unknown function |
| 387 | YLR125W | — | 6.28348756 | 2.642933 | 3.1335402 | Protein of unknown function |
| 388 | YML035C | (AMD1) | 2.23864371 | 2.6401405 | 1.6690608 | AMP deaminase, converts AMP to IMP and ammonia |
| 389 | YMR165C | (SMP2) | 2.58642399 | 2.6310411 | 3.3572604 | Protein whose deletion causes increased plasmid stability |
| 390 | YDL223C | — | 3.16684859 | 2.6240147 | 2.2340877 | Protein of unknown function |
| 391 | YLR138W | — | 2.69090586 | 2.6158483 | 2.9821754 | — |
| 392 | YAR020C | — | 3.79173888 | 2.6111125 | 2.0234222 | — |
| 393 | YLR337C | (VRP1) | 6.57336326 | 2.6027011 | 3.7504037 | Proline-rich protein verprolin, involved in cytoskeletal organization and cellular growth |
| 394 | YLR060W | (FRS1) | 2.61550639 | 2.5992071 | 1.9335426 | Phenylalanyl-tRNA synthetase, alpha subunit, cytoplasmic |
| 395 | YLL013C | — | 2.93447915 | 2.5901954 | 4.1297767 | Protein with similarity to drosophila pumilio protein |
| 396 | YIR003W | — | 2.41363594 | 2.5863745 | 2.874494 | Protein with similarity to E. coli and Bacillus subtilis mind, has potential coiled-coil region |
| 397 | YIL137C | — | 2.27968603 | 2.5792356 | 1.9624104 | Protein with similarity to aminopeptidases |
| 398 | YBL081W | — | 2.34404421 | 2.573205 | 3.2079939 | Protein with 37% identity to drosophila L not protein |
| 399 | YOR171C | — | 3.59659097 | 2.5718305 | 2.4035974 | — |
| 400 | YPL237W | (SUI3) | 2.5966981 | 2.5628077 | 2.5479456 | Translation initiation factor EIF2beta subunit |
| 401 | YHR142W | — | 3.52383057 | 2.5597096 | 2.9887896 | Protein of unknown function |
| 402 | YLL012W | — | 3.25020683 | 2.550591 | 2.7451737 | Protein with similarity to human triacylglycerol lipase |
| 403 | YFR025C | (HIS2) | 2.5112362 | 2.5457991 | 2.8789156 | Histidinol phosphatase |
| 404 | YGR240C | (PFK1) | 2.24103063 | 2.5388997 | 2.4938739 | Phosphofructokinase alpha subunit, part of a complex with PFK2P which carries out A key regulatory step in glycolysis |
| 405 | YPL101W | — | 4.18961695 | 2.5351195 | 2.6201803 | Protein of unknown function |
| 406 | YOR127W | (RGA1) | 3.85804733 | 2.5316649 | 2.5697341 | RHO-type GTPase-activating protein (GAP) for CDC42P |
| 407 | YBR088C | (POL30) | 2.5383718 | 2.5276319 | 4.0628861 | Proliferating cell nuclear antigen (PCNA), required for DNA synthesis and DNA repair |
| 408 | YBR295W | (PCA1) | 4.16669535 | 2.525791 | 1.1221384 | P-type copper-transporting ATPase |
| 409 | YCL044C | — | 2.35958836 | 2.519608 | 3.263571 | Protein of unknown function |
| 410 | YBR110W | (ALG1) | 2.23384099 | 2.5141215 | 3.2250999 | Beta-mannosyltransferase involved in N-glycosylation (transfers MAN from GDP-MAN to DOL-PP-GLCNAC2) |
| 411 | YGR175C | (ERG1) | 6.02726287 | 2.5103577 | 1.8132661 | Squalene monooxygenase (squalene epoxidase), enzyme of the ergosterol biosynthesis pathway |
| 412 | YLR116W | — | 2.98116702 | 2.5079761 | 3.9707409 | — |
| 413 | YCR068W | — | 3.32107678 | 2.4920381 | 3.6811994 | Protein of unknown function |
| 414 | YJR105W | — | 2.20476096 | 2.4908887 | 1.7029385 | Protein with similarity to ribokinase |
| 415 | YKL157W | (APE2) | 2.18209838 | 2.4866194 | 2.093134 | Aminopeptidase II (YSCII), plays a nutritional role in releasing leucine from peptides externally cleaved at leucine |
| 416 | YFR009W | (GCN20) | 2.63782118 | 2.4859544 | 2.1613378 | Component of a protein complex required for activation of GCN2P protein kinase in response to amino acid starvation, member of ATP-binding cassette (ABC) superfamily |
| 417 | YDR211W | (GCD6) | 2.22567451 | 2.4835485 | 1.8240639 | Translation initiation factor EIF2B (guanine nucleotide exchange factor), 81 KDA (beta) subunit |
| 418 | YAR060C | — | 4.88485967 | 2.482682 | 4.6114571 | Protein identical to YHR212P, has a predicted mitochondrial transit peptide |
| 419 | YJL187C | (SWE1) | 2.01161328 | 2.4809757 | 2.6294797 | Serine/tyrosine dual-specificity protein kinase able to phosphorylate CDC28P on tyrosine and inhibit its activity |
| 420 | YDR387C | — | 2.3225348 | 2.4746572 | 3.0481024 | Protein with similarity to ITR1P and ITR2P |
| 421 | YDR251W | (PAM1) | 2.09471237 | 2.4744652 | 2.3344613 | Coiled-coil protein and multicopy suppressor of loss of PP2A (genes PPH21, PPH22, and PPH3) |
| 422 | YJL172W | (CPS1) | 2.4464951 | 2.473092 | 2.228723 | GLY-X carboxypeptidase YSCS, involved in nitrogen metabolism |
| 423 | YMR277W | (FCP1) | 2.51675116 | 2.466666 | 2.2346158 | TFIIF-interacting component of the C-terminal domain phosphatase |
| 424 | YDL047W | (SIT4) | 2.40214863 | 2.4572974 | 2.7529791 | Protein serine/threonine phosphatase involved in cell cycle regulation, member of the PPP family of protein phosphatases and related to PP2A phosphatases |

TABLE 2*-continued

| Seq. Num. | Clone ID | ALIAS | CJ-4hr/ LP-4hr | K-50/CK | K-100/CK | Gene Description |
|---|---|---|---|---|---|---|
| 425 | YML117W | — | 2.2473701 | 2.4482108 | 2.8054783 | Protein of unknown function, contains an ATP/GTP-binding site motif A (P-loop) |
| 426 | YHR039C-A | — | 2.49103418 | 2.4469729 | 1.7368373 | — |
| 427 | YLL003W | (SFI1) | 3.03031186 | 2.4467012 | 2.2685901 | Protein of unknown function |
| 428 | YKR048C | (NAP1) | 3.02222721 | 2.4404483 | 3.002619 | Nucleosome assembly protein that plays a role in assembly of histones into octamer, required for full expression of CLB2P functions |
| 429 | YOR197W | — | 2.87645711 | 2.438206 | 1.9784081 | Protein of unknown function |
| 430 | YEL046C | (GLY1) | 2.40664526 | 2.4369367 | 2.6795853 | Protein required for glycine prototrophy in SHMT1 SHMT2 double mutant |
| 431 | YJL029C | — | 2.36823878 | 2.43429 | 2.3384644 | Protein of unknown function, has similarity to C. elegans hypothetical protein T05G5.8 |
| 432 | YOR233W | (KIN4) | 3.52231883 | 2.4312627 | 3.0678435 | Serine/threonine protein kinase related to KIN1P and KIN2P, catalytic domain is most related to SNF1P |
| 433 | YOR299W | (BUD7) | 2.16058794 | 2.4312223 | 2.9585581 | Protein required for bipolar budding pattern |
| 434 | YHR218W | — | 2.37694362 | 2.4297245 | 4.1990669 | Protein with similarity to other subtelomerically-encoded proteins including YHR219P and YFL065P, probable pseudogene |
| 435 | YGL026C | (TRP5) | 3.92053304 | 2.4267316 | 2.4752996 | Tryptophan synthase, last (fifth) step in tryptophan biosynthesis pathway |
| 436 | YJL017W | — | 2.745014 | 2.4179146 | 2.8613495 | Protein of unknown function |
| 437 | YNL161W | — | 4.7525671 | 2.4161417 | 2.324762 | Serine/threonine protein kinase of unknown function |
| 438 | YOR141C | (ARP8) | 5.68817037 | 2.4122798 | 1.7395537 | Protein with similarity to actin and actin-related proteins ARP1P–ARP10P |
| 439 | YAL042W | — | 2.84377325 | 2.4057529 | 3.7961408 | Protein of unknown function, has 2 potential transmembrane domains |
| 440 | YGR270W | (YTA7) | 2.68803581 | 2.4056715 | 1.945755 | Protein with similarity to members of the AAA family of ATPases |
| 441 | YBR119W | (MUD1) | 2.83912216 | 2.4051525 | 1.3987642 | U1 SNRNP A protein (SNRNA-associated protein) with 2 RNA recognition (RRM) domains |
| 442 | YDR052C | (DBF4) | 6.85835185 | 2.4036928 | 1.5834960 | Regulatory subunit for CDC7P protein kinase, required for G1/S transition |
| 443 | YEL069C | (HXT13) | 2.69020108 | 2.4013304 | 3.6711431 | Protein with strong similarity to hexose transporters, member of the sugar permease family |
| 444 | YDR285W | (ZIP1) | 8.03633767 | 2.3921886 | 0.2216256 | Structural protein of the synaptonemal element central element, has predicted coiled-coil domain |
| 445 | YJL047C | — | 2.8960182 | 2.3885065 | 2.0814157 | Protein with similarity to clathrin heavy chain in one domain |
| 446 | YKL101W | (HSL1) | 4.2235071 | 2.3780286 | 2.4485279 | Serine/threonine protein kinase that interacts genetically with histone mutations |
| 447 | YIL143C | (SSL2) | 2.16202858 | 2.3668818 | 1.9944618 | DNA helicase component of RNA polymerase transcription initiation factor TFIIH (factor B) |
| 448 | YBR182C | — | 3.15043584 | 2.3653183 | 2.517131 | — |
| 449 | YER189W | — | 2.65287612 | 2.3630614 | 5.1724275 | Protein with similarity to subtelomerically-encoded proteins including YIL177P, YHL049P, and YJL225P |
| 450 | YLR194C | — | 3.11287981 | 2.3617044 | 2.923307 | Protein of unknown function |
| 451 | YGR160W | — | 2.13853989 | 2.3577684 | 1.8132562 | Protein of unknown function |
| 452 | YGR258C | (RAD2) | 2.06944636 | 2.3572245 | 2.1751698 | Structure-specific single-stranded DNA endonuclease of the nucleotide excision repairosome |
| 453 | YGR162W | (TIF4631) | 2.28099935 | 2.3554791 | 1.7039222 | MRNA CAP-binding protein (EIF4F) 150K subunit |
| 454 | YJR036C | — | 3.21027204 | 2.3546452 | 5.0712893 | Possible ubiquitin-protein ligase (E3) |
| 455 | YGR124W | (ASN2) | 3.37829988 | 2.3505148 | 2.4742017 | Asparagine synthetase (L-aspartate; L-glutamine amidoligase [AMP-forming]), ASN1P and ASN2P are isozymes |
| 456 | YDL180W | — | 2.20643197 | 2.3467843 | 1.8047293 | Protein of unknown function |
| 457 | YDR266C | — | 3.29383065 | 2.3411759 | 2.3118864 | Protein of unknown function |
| 458 | YAR073W | — | 7.67257484 | 2.3325262 | 1.6890618 | Protein with strong similarity to PUR5P, may be an inosine-5'-monophosphate dehydrogenase |
| 459 | YPL048W | (CAM1) | 2.18528771 | 2.3294863 | 3.3106924 | — |
| 460 | YEL030W | (ECM10) | 1.99868799 | 2.3236082 | 2.3835153 | Protein possibly involved in cell wall structure or biosynthesis |
| 461 | YLL058W | — | 6.13836096 | 2.3223158 | 2.3541199 | Protein with similarity to neurospora crassa O-succinylhomoserine (thiol)-lyase |
| 462 | YJR010W | (MET3) | 8.36384636 | 2.3172147 | 1.5113084 | ATP-sulfurylase (sulfate adenylyltransferase) |
| 463 | YER110C | (KAP123) | 3.02732098 | 2.3160572 | 1.8042941 | Karyopherin-beta, involved in nuclear import of ribosomal proteins |

TABLE 2*-continued

| Seq. Num. | Clone ID | ALIAS | CJ-4hr/ LP-4hr | K-50/CK | K-100/CK | Gene Description |
|---|---|---|---|---|---|---|
| 464 | YGL063W | (PUS2) | 2.17517427 | 2.3124794 | 4.1754638 | Pseudouridine synthase |
| 465 | YPL184C | — | 3.3404012 | 2.3122475 | 2.2563666 | Protein of unknown function |
| 466 | YGR254W | (ENO1) | 2.05650599 | 2.3095639 | 1.9054756 | Enolase 1 (2-phosphoglycerate dehydratase), converts 2-phospho-D-glycerate to phosphoenolpyruvate in glycolysis |
| 467 | YIL108W | — | 3.15926869 | 2.3086561 | 2.5782072 | Protein of unknown function |
| 468 | YDR388W | (RYS167) | 2.34115713 | 2.3058518 | 2.6912527 | Protein with A SH3 domain that affects actin distribution and bipolar budding |
| 469 | YNL323W | — | 2.29668952 | 2.3038327 | 2.0645985 | Protein with similarity to YCX1P |
| 470 | YBL076C | (ILS1) | 2.31635893 | 2.3036041 | 1.7634202 | Isoleucyl-TRNA synthetase |
| 471 | YLR217W | — | 2.57939547 | 2.2859565 | 1.6611523 | Protein of unknown function |
| 472 | YGR294W | — | 8.48668724 | 2.2857763 | 1.7132102 | Protein of the PAU1 family |
| 473 | YDL070W | — | 2.16064033 | 2.2854538 | 3.7599153 | — |
| 474 | YOL044W | — | 2.15373467 | 2.2849315 | 2.1736446 | — |
| 475 | YGL145W | (TIP20) | 4.18903489 | 2.2829973 | 1.6161221 | Cytoplasmic protein that interacts physically with SEC20P, required for ER to Golgi transport |
| 476 | YLR044C | (PDC1) | 2.21772333 | 2.2774972 | 1.9431592 | Pyruvate decarboxylase isozyme I |
| 477 | YNR013C | — | 2.0080141 | 2.2770842 | 2.4893728 | Protein with similarity to PHO87P and YJL198P, member of the phosphate permease family of the major facilitator superfamily (MFS) |
| 478 | YML049C | — | 2.08547393 | 2.2761395 | 2.0329879 | — |
| 479 | YDR221W | — | 2.53153283 | 2.2731861 | 1.8131644 | Protein with similarity to the beta subunit of human glucosidase II |
| 480 | YMR135C | — | 4.75727106 | 2.2636411 | 4.3609747 | Protein of unknown function |
| 481 | YKR001C | (YPS1) | 2.48277065 | 2.2630712 | 1.5678763 | Vacuolar sorting protein, member of the dynamin family of GTPases |
| 482 | YLR413W | — | 2.80009402 | 2.2629262 | 2.3695083 | Protein of unknown function |
| 483 | YDR122W | (KIN1) | 2.0434064 | 2.2623436 | 2.3432635 | Serine/threonine protein kinase, related to KIN2P and S. pombe KIN1 |
| 484 | YIL154C | (IMP2') | 2.216207 | 2.2548739 | 2.2466776 | — |
| 485 | YKL068W | (NUP100) | 2.2598003 | 2.2529093 | 2.7012733 | Nuclear pore protein (nucleoporin) of the GLFG family, may be involved in binding and translation of proteins during nucleocytoplasmic transport |
| 486 | YHR190W | (ERG9) | 2.81318531 | 2.2475123 | 1.7238705 | Squalene synthesis (farnesyl-diphosphate farnestransferase), acts as a branch point in the isoprenoid biosynthesis pathway |
| 487 | YGL179C | — | 4.83814707 | 2.2398396 | 3.8786749 | Serine/threonine protein kinase with similarity to ELM1P and KIN82P |
| 488 | YOL017W | — | 3.01741322 | 2.2303862 | 2.2459064 | Protein of unknown function |
| 489 | YHR189W | — | 2.0021212 | 2.22911 | 2.2289936 | Putative peptidyl-TRNA hydrolase (PTH) |
| 490 | YNL208W | — | 3.64860898 | 2.2181817 | 2.5247363 | Protein of unknown function |
| 491 | YHR04LC | (SRB2) | 2.27216109 | 2.2178582 | 2.4847273 | Component of the RNA polymerase II holoenzyme and Kornberg's mediator (SRB) subcomplex |
| 492 | YPR080W | (TEF1) | 2.50402057 | 2.2115095 | 1.8587879 | Translation elongation factor EF-1alpha (TEF1 TEF2 code for identical proteins) |
| 493 | YBR229C | (ROT2) | 2.45186053 | 2.2034499 | 2.1844611 | Catalytic (alpha) subunit of glucosidase II |
| 494 | YGR262C | — | 2.83275613 | 2.2029336 | 1.9251756 | Protein with similarity to apple tree calcium/calmodulin-binding protein kinase PIR:JQ2225I |
| 495 | YER144C | (UBP5) | 3.38126089 | 2.1994294 | 2.7106303 | Ubiquitin-specific protease (ubiquitin C-terminal hydrolase), homologous to DOA4P and human TRE-2 |
| 496 | YDR264C | (AKR1) | 3.13151279 | 2.1983967 | 2.7516536 | Ankyrin repeat-containing protein that has an inhibitory effect on signaling in the pheromone pathway |
| 497 | YLR427W | — | 2.2498541 | 2.1938243 | 2.5059695 | Protein of unknown function |
| 498 | YLR374C | — | 2.26923061 | 2.1927227 | 2.6395044 | Protein of unknown function |
| 499 | YMR092C | (AIP1) | 2.2241966 | 2.1917074 | 2.1939749 | Actin interacting protein, has 4 WD (WD-40) repeats |
| 500 | YDR294C | — | 2.20085342 | 2.1899557 | 2.3333139 | — |
| 501 | YMR296C | (LCB1) | 2.1334221 | 2.1891645 | 1.9030014 | Component of serin C-palmitoyltransferase, first step in biosynthesis of long-chain base component of sphingolipids |
| 502 | YKR039W | (GAP1) | 1.99105648 | 2.1881751 | 1.2556866 | General amino acid permease, proton symport transporter for all naturally-occurring L-amino acids, 4-aminobutyric acid (GABA), ornithine, citrulline, some D-amino acids, and some toxic analogs |
| 503 | YDR422C | (SIP1) | 2.62373247 | 2.1870761 | 2.0836347 | Multicopy suppressor of SNF1, related to GAL83P/SPM1P and SPM2P |

TABLE 2*-continued

| Seq. Num. | Clone ID | ALIAS | CJ-4hr/ LP-4hr | K-50/CK | K-100/CK | Gene Description |
|---|---|---|---|---|---|---|
| 504 | YMR080C | (NAM7) | 2.82340116 | 2.1828046 | 2.1714828 | Protein involved with NMD2P and UPF3P in decay of MRNA containing nonsense codons |
| 505 | YBL106C | — | 2.38138747 | 2.1809814 | 2.7798326 | — |
| 506 | YEL043W | — | 3.44125375 | 2.1784956 | 2.8076042 | Protein of unknown function |
| 507 | YBR222C | (FAT2) | 5.13679804 | 2.1781103 | 3.0936394 | Peroxisomal AMP-binding protein |
| 508 | YDR004W | (RAD57) | 2.26389978 | 2.1754266 | 2.076582 | Component of recombinosome complex involved in meiotic recombination and recombinational repair, with RAD55P promotes DNA strand exchange by RAD51P recombinase |
| 509 | YHR174W | (ENO2) | 2.38714668 | 2.1702816 | 1.9697417 | Enolase 2(2-phosphoglycerate dehydratase), converts 2-phospho-D-glycerate to phosphoenolpyruvate in glycolysis |
| 510 | YER043C | (SAH1) | 3.73200717 | 2.1669937 | 1.6246235 | Adenosylhomocysteinase (S-adenosylhomocysteine hydrolase) |
| 511 | YKR012C | — | 2.41358469 | 2.1555775 | 1.1414615 | Protein of unknown function |
| 512 | YOL007C | — | 3.17872347 | 2.1529948 | 1.2712945 | — |
| 513 | YMR220W | (ERG8) | 2.68816133 | 2.1489328 | 2.0693924 | Phosphomevalonate kinase, converts mevalonate-5-phosphate to mevalonate pyrophosphate, involved in isoprene and ergosterol biosynthesis pathways |
| 514 | YDR062W | (LCB2) | 2.54448949 | 2.1430094 | 1.9627647 | Subunit of serine C-palmitoyltransferase, first step in sphingolipic biosynthesis, and suppressor of calcium-sensitivity of CSG2 |
| 515 | YAL048C | — | 5.02313141 | 2.1384748 | 4.221132 | Protein with weak similarity to RAS1P, RAS2P, and other GTP-binding proteins of the RAS superfamily |
| 516 | YBL111C | — | 2.17340644 | 2.1313903 | 3.8030907 | — |
| 517 | YJL108C | — | 4.56646166 | 2.1302533 | 2.8609713 | Protein of unknown function, contains 8 potential transmembrane domains |
| 518 | YJL141C | (YAK1) | 2.80000608 | 2.1277388 | 2.8291776 | Serine/threonine protein kinase, negative regulator of cell growth acting in opposition to CAMP-dependent protein kinase A |
| 519 | YJL102W | (MEF2) | 2.08592026 | 2.1220696 | 1.6098307 | Mitochondrial translation elongation factor, promotes GTP-dependent translocation of nascent chain from A-site to P-site of ribosome |
| 520 | YDL174C | (DLD1) | 2.28050309 | 2.1220649 | 2.4305801 | D-lactate dehydrogenase (cytochrome), (D-lactate ferricytochrome C oxidoreductase) (D-LCR), mitochondrial |
| 521 | YMR011W | (HXT2) | 7.25080973 | 2.1188378 | 1.6420019 | High-affinity hexose transporter, member of sugar permease family |
| 522 | YLR129W | (DIP2) | 3.36115373 | 2.1126408 | 2.0325416 | DOM34P-interacting protein, has WD (WD-40) repeats |
| 523 | YML008C | (ERG6) | 2.51872662 | 2.1091692 | 1.7889829 | S-adenosylmethionine delta-24-sterol-C-methyltransferase, carries out methylation of zymosterol as part of the ergosterol biosynthesis pathway |
| 524 | YGL245W | — | 2.30162026 | 2.1065078 | 1.4267053 | Glutamyl-TRNA synthetase, member of the Class I aminoacyl TRNA synthetase family |
| 525 | YGL024W | — | 2.67631735 | 2.1046757 | 1.4610387 | Protein of unknown function |
| 526 | YHL027W | (RIM101) | 2.57210755 | 2.1033157 | 2.5927892 | Zinc-finger protein involved in induction of IME1 |
| 527 | YGR281W | (YOR1) | 4.18259907 | 2.0935061 | 2.3634092 | Oligomycin-resistance factor, member of the ATP-binding cassette (ABC) superfamily |
| 528 | YIL175W | — | 2.10803474 | 2.0859355 | 2.4771166 | — |
| 529 | YHL019C | (APM2) | 1.9956708 | 2.0845729 | 3.0618718 | Clathrin-associated protein (AP) complex, medium subunit |
| 530 | YAL019W | (FUN30) | 5.19927199 | 2.0806959 | 1.7340212 | — |
| 531 | YGL112C | (TAF60) | 2.21463331 | 2.0765265 | 2.1891308 | Component of TAF(II) complex (TBP-associated protein complex) required for activated transcription by RNA polymerase II |
| 532 | YNL218W | — | 2.28887465 | 2.0761 | 1.6749939 | Protein with similarity to E. coli DNA polymerase III gamma and TAU subunits |
| 533 | YML058C-A | — | | 217.969407 | 2.0723568 | 3.2869214 |
| 534 | YOL156W | (HXT11) | 5.12784966 | 2.0709411 | 2.2192118 | Low-affinity glucose permease |
| 535 | YGR218W | (CRM1) | 2.32581989 | 2.0675233 | 1.5505702 | Exportin, beta-karyopherin |
| 536 | YGR296W | — | 3.15948331 | 2.0664535 | 3.7402619 | Protein with similarity to other subtelomerically-encoded proteins including YER190P (YPL283 and YGR296W code for identical proteins) |
| 537 | YLR176C | — | 2.54329087 | 2.0627475 | 1.4892288 | — |
| 538 | YDL229W | (SSB1) | 5.21935107 | 2.0615889 | 2.0067653 | Heat shock protein of HSP70 family involved in the translational apparatus |

TABLE 2*-continued

| Seq. Num. | Clone ID | ALIAS | CJ-4hr/ LP-4hr | K-50/CK | K-100/CK | Gene Description |
|---|---|---|---|---|---|---|
| 539 | YER034W | — | 2.57654853 | 2.0562947 | 1.9025056 | Protein of unknown function |
| 540 | YKR050W | (TRK2) | 2.23638067 | 2.056259 | 4.703529 | Potassium transporter of the plasma membrane, moderate affinity, member of the potassium permease family of the major facilitator superfamily |
| 541 | YIL113W | — | 7.07756282 | 2.0539759 | 2.28618 | Dual-specificity protein phosphatase |
| 542 | YCR023C | — | 2.01851078 | 2.0520751 | 2.2109695 | Member of major facilitator superfamily (MFS) multidrug-resistance protein family 2 |
| 543 | YMR069W | — | 4.45745957 | 2.0520592 | 0 | Protein of unknown function |
| 544 | YAL020C | (ATS1) | 3.02597511 | 2.050802 | 2.0781706 | Protein with similarity to human RCC1 protein, suppressor of mutations in alpha tubulin |
| 545 | YNL256W | — | 3.16308725 | 2.045577 | 1.8697374 | Protein with similarity to bacterial dihydropteroate synthase |
| 546 | YMR124W | — | 2.65610298 | 2.0431312 | 2.2988806 | Protein of unknown function, has potential coiled-coil region (GB:Z49273) |
| 547 | YOR162C | — | 2.4478098 | 2.0361958 | 2.1075035 | — |
| 548 | YOR353C | — | 2.20965265 | 2.0220258 | 1.7471747 | Protein with weak similarity to adenylate cyclases |
| 549 | YPL028W | (ERG10) | 2.86559138 | 2.0185951 | 1.6989337 | Acetyl-COA acetyltransferase (acetoacetyl-COA thiolase), first step in mavalonate/sterol pathway |
| 550 | YIL114C | (POR2) | 2.24322702 | 2.0152799 | 2.367678 | Outer mitochondrial membrane porin (voltage-dependent anion-selective channel) |
| 551 | YDL029W | (ACT2) | 2.07186888 | 2.0140172 | 1.810394 | — |
| 552 | YDL143W | (CCT4) | 2.3041307 | 2.0128325 | 1.6478427 | Component of chaperonin-containing T-complex (TCP ring complex, TRIC), homologous to mouse CCT4 |
| 553 | YPL267W | — | 2.06501413 | 2.0119076 | 1.6761922 | Protein of unknown function |
| 554 | YOL105C | — | 2.79225712 | 2.0026061 | 2.23737 | — |
| 555 | YML004C | (GLO1) | 2.19630894 | 2.0015677 | 1.7985136 | Glyoxalase I, converts methylglyoxal and glutathione into S-D-lactoylglutathione |
| 556 | YMR266W | — | 2.47393267 | 1.991188 | 1.727182 | Protein of unknown function, probable integral membrane glycoprotein |
| 557 | YPL194W | — | 2.87006368 | 0.4961465 | 1.5346869 | — |
| 558 | YOR152C | — | 2.74047761 | 0.4915256 | 0.2221023 | Protein of unknown function |
| 559 | YDR242W | (AMD2) | 8.28951711 | 0.4819032 | 0.9215489 | Protein with similarity to amidases |
| 560 | YFL054C | — | 7.43223753 | 0.4793582 | 0.6136582 | Protein with similarity to FPS1P and YPR192P, member of M1P family of transmembrane channels |
| 561 | YAR068W | — | 3.24259317 | 0.479021 | 1.2297001 | Protein with similarity to ICWP protein |
| 562 | YAL001C | (TFC3) | 2.94740587 | 0.4742746 | 1.1915566 | RNA polymerase transcription initiation factor TFIIC (TAU), 138 KDA subunit |
| 563 | YLR454W | — | 5.72921213 | 0.4716283 | 1.641906 | Protein of unknown function |
| 564 | YDL020C | (SON1) | 2.27378766 | 0.4591519 | 0.8208918 | — |
| 565 | YMR225C | (MRPL44) | 0.19372389 | 0.4430311 | 0.4019617 | Mitochondrial ribosomal protein of the large subunit (YMR44) |
| 566 | YJR038C | — | 9.06373624 | 0.4422872 | 4.1801655 | Protein of unknown function |
| 567 | YDR380W | — | 0.1136124 | 0.4417559 | 0.8241167 | Protein with similarity to pyruvate decarboxylase, pyruvate oxidase, acetolactate synthase (large subunit), and other enzymes that require thiamine pyrophosphate |
| 568 | YKL170W | (MRPL38) | 0.20347891 | 0.4296401 | 0.4533368 | Mitochondrial ribosomal protein of the large subunit (YML38) (*E. coli* L14), belongs to the L14 family of prokaryotic ribosomal proteins |
| 569 | YGR248W | (SOL4) | 0.17664863 | 0.4293198 | 0.4062793 | Protein of unknown function |
| 570 | YER058W | (PET117) | 0.18996331 | 0.4289442 | 0.4202828 | Protein involved in assembly of cytochrome oxidase |
| 571 | YBR039W | (ATP3) | 0.18787084 | 0.4197886 | 0.2837245 | F1-gamma ATP synthase |
| 572 | YDL102W | (CDC2) | 17.5853214 | 0.4169873 | 0.0258767 | — |
| 573 | YJR153W | — | 3.65551445 | 0.4116558 | 0.6086987 | — |
| 574 | YMR188C | — | 0.20743995 | 0.4113817 | 0.3381207 | Protein with similarity to 30S ribosomal proteins (S17) |
| 575 | YBR244W | — | 0.16093632 | 0.4035137 | 0.3438917 | Protein with similarity to glutathione peroxidase |
| 576 | YDR523C | (SPS1) | 10.8815611 | 0.4014712 | 0.3371725 | Serine/threonine protein kinase involved in middle/late stage of meiosis |
| 577 | YDL031W | — | 2.0561223 | 0.3989968 | 0.6791327 | Protein with similarity of RNA helicases of dead/DEAH box family |
| 578 | YER109C | (FLO8B) | 2.33584341 | 0.3826502 | 2.0529509 | — |
| 579 | YIR017C | (MET28) | 2.97658904 | 0.3775372 | 0.3008895 | Transcriptional activator of the basic leucine zipper (BZIP) family, works with MET4P and CBF1P to regulation sulfur amino acid metabolism |

TABLE 2*-continued

| Seq. Num. | Clone ID | ALIAS | CJ-4hr/ LP-4hr | K-50/CK | K-100/CK | Gene Description |
|---|---|---|---|---|---|---|
| 580 | YDL016C | — | 3.9417341 | 0.374232 | 0.2672688 | Protein of unknown function |
| 581 | YIR028W | (DAL4) | 2.5006493 | 0.3741716 | 3.0010653 | Allantoin permease, member of the uracil/allantoin permease family of the major facilitator superfamily (MFS) |
| 582 | YOR124C | (UBP2) | 2.8382974 | 0.3622925 | 0.3859773 | Ubiquitin-specific protease (ubiquitin C-terminal hydrolase), cleaves at the C-terminus of ubiquitin |
| 583 | YBL108W | — | 0.1900473 | 0.3575329 | 0.5467376 | Protein of unknown function |
| 584 | YDR259C | — | 5.62713626 | 0.3429355 | 0.2335082 | — |
| 585 | YDR253C | (MET32) | 2.86314943 | 0.3397175 | 0.3279043 | Zinc-finger protein involved in transcriptional regulation of methionine metabolism |
| 586 | YJL196C | (ELO1) | 0.17135352 | 0.3378086 | 0.3752547 | Fatty acid elongation protein involved in elongation of tetradecanoic acid to hexadecanole acid |
| 587 | YDR141C | — | 0.09160554 | 0.3290633 | 0.1693929 | Protein of unknown function, member of the major facilitator superfamily (MFS) |
| 588 | YBR069C | (VAP1) | 3.0181038 | 0.3157547 | 1.2268269 | Amino acid permease for valine, leucine, isoleucine, tyrosine, and tryptophan |
| 589 | YOR314W | — | 2.65430513 | 0.2917342 | 0.3312621 | Protein of unknown function |
| 590 | YDL068W | — | 0.11556176 | 0.2684108 | 0.1521109 | Protein of unknown function |
| 591 | YPL136W | — | 2.17418921 | 0.2530647 | 3.1708409 | Protein of unknown function |
| 592 | YGL034C | — | 0.1411795 | 0.2524039 | 0.3723439 | Protein of unknown function |
| 593 | YLR162W | — | 4.13626663 | 0.2515583 | 0.6851592 | Protein of unknown function |
| 594 | YMR193C-A | — | 3.34099753 | 0.2354896 | 0.3596816 | — |
| 595 | YMR146C | (TIF34) | 5.0351989 | 0.2248204 | 0.7193538 | Translation initiation factor EIF3, P39 subunit, has 2 WD (WD-40) repeats |
| 596 | YFL012W | — | 71.9436495 | 0.2235373 | 1.5215902 | Protein of unknown function |
| 597 | YER096W | — | 7.21258235 | 0.1766673 | 0.4170679 | — |
| 598 | YNR071C | — | 2.01488788 | 0.1446196 | 0.0535063 | Protein with similarity to UDPglucose 4-epimerase |
| 599 | YLR419W | — | 0.20769335 | 0.1102431 | 0.9141258 | Protein with similarity to several pre-MRNA splicing factors |
| 600 | YKL105C | — | 3.23146223 | 0.086572 | 5.0836556 | Protein of unknown function |
| 601 | YLR142W | (PUT1) | 2.2907881 | 0.0854218 | 0.6671487 | Proline oxidase, first step in synthesis of glutamate from proline |
| 602 | YDL239C | — | 7.81000565 | 0.0417738 | 0.347901 | Protein of unknown function |
| 603 | YHR137W | (ARO9) | 0.07724918 | 0.0347684 | 0.0703134 | Aromatic amino acid aminotransferase II |
| 604 | YDR374C | — | 17.25276 | 0 | 4.6059679 | Protein of unknown function |
| 605 | YIL100W | — | 9.97598883 | 0 | 2.8122773 | Protein of unknown function, questionable ORF |
| 606 | YPL025C | — | 9.52247441 | 0 | 20.22382 | Protein of unknown function |
| 607 | YOR072W | — | 7.48662389 | 0 | 6.2287404 | Protein of unknown function |
| 608 | YNL242W | — | 6.47720448 | 0 | 2.5753253 | Protein of unknown function |
| 609 | YIR027C | (DAL1) | 5.64113227 | 0 | 0 | Allantoinase, first step in the degradation of allantoin as a secondary nitrogen source |
| 610 | YOR139C | — | 5.46648132 | 0 | 11.760995 | Transcription factor with domains homologous to MYC oncoprotein and yeast HSF1P, required for normal cell surface assembly and flocculence |
| 611 | YEL019C | (MMS21) | 3.34008483 | 0 | 2.069236 | Protein of unknown function |
| 612 | YDL132W | (cdc53) | 3.16426832 | 0 | 0.1467847 | — |
| 613 | YOR177C | — | 2.97842594 | 0 | 0.435871 | Protein of unknown function |
| 614 | YML042W | (CAT2) | 2.76437696 | 0 | 16.65885 | Carnitine O-acetyltransferase, peroxisomal and and mitochondrial |
| 615 | YER044C-A | (MEI4) | 2.5971776 | 0 | 0 | Protein required early in meiosis for meiotic recombination, chromosome synapsis, and viable spore formation |
| 616 | YGR083C | (GCD2) | 2.32134339 | 0 | 0 | Translation initiation factor EIF2B (guanine nucleotide exchange factor), 71 KDA (delta) subunit |
| 617 | YAR030C | — | 2.06301879 | 0 | 0 | Protein of unknown function, probable non-coding ORF |

TABLE 2*-continued

| Seq. Num. | Clone ID | ALIAS | CJ-4hr/ LP-4hr | K-50/CK | K-100/CK | Gene Description |
|---|---|---|---|---|---|---|
| 618 | YJR157W | — | 0.2073771 | 0 | 0.6711879 | Protein of unknown function |
| 619 | YHR217C | — | 0.2061042 | 0 | 0.549346 | Protein of unknown function |
| 620 | YKL100C | — | 0.12715731 | 0 | 40.399169 | Protein of unknown function |

*Table Headings:
Clone ID: A clone ID designation number.
Alias: Alternative gene names used in the literature. This information is provided by YPD ™, Hodges et al. Nucl. Acids Res. 27: 69–73 (1999), the entirety of which is herein incorporated by reference.
CJ-4hr/LP-4hr: Expression level in the mutant CJ517 as compared with the respective wild type strain LPY9 at 4hr sampling of log phase growth of yeast (ratio of mutant expression level/control expression level). CJ refers to the mutant CJ517 (The mutant is defective in the gene (ERG11) codes for C14 demethylase enzyme in the sterol biosynthetic pathway). LP refers to the respective wild type strain LPY9, used to compare the gene expression profile with the mutant.
K-50/CK: Expression level in the wild type yeast LPY9, at 2 hr after treatment with 50 micro gram/ml ketoconazole as compared to the wild type LPY9 strain without ketoconazole treatment (ratio of treatment expression level/control expression level). K refers to ketoconazole treatment. The clones listed in Table 2 are either up or down regulated in the mutant (CJ517) as well as in response to ketoconazole treatment.
K-100/CK: Expression level in the wild type yeast LPY9, at 2 hr after treatment with 100 micro gram/ml ketoconazole as compared to the wild type LPY9 strain without ketoconazole treatment (ratio of treatment expression level/control expression level).
Gene Description: Description of the clone listed in column 1.

Table 3, below, lists the RNAs from Table 2 that correspond to genes or structural regions implicated in transcription regulation.

TABLE 3*

| Seq. Num. | Clone ID | ALIAS | CJ-4 hr/ LP-4 hr | K-50/CK | K-100/CK | Gene Description |
|---|---|---|---|---|---|---|
| 30 | YOR237W | (HES1) | 134.648161 | 1417.62621 | 1358.12348 | Protein implicated in ergosterol biosynthesis, member of the KES1/HES1/OSH1/YKR003W family of oxysterol-binding (OSBP) proteins |
| 42 | YDR213W | — | 18.2079478 | 32.1360646 | 58.3586116 | Protein with similarity to transcription factors, has ZN[2]-CYS[6] fungal-type binuclear cluster domain in the N-terminal region |
| 74 | YGR177C | (ATF2) | 3.7081426 | 11.830167 | 12.5552685 | Alcohol O-acetyltransferase |
| 75 | YFR034C | (PHO4) | 14.8112083 | 11.2160731 | 20.8445145 | Basic helix-loop-helix (BHLH) transcription factor required for expression of phosphate pathway, hyperphosphorylation by PHO80P-PHO85P cyclin-dependent protein kinase complex causes inactivation |
| 83 | YOL067C | (RTG1) | 30.4142081 | 10.0270648 | 27.3663295 | Basic helix-loop-helix (BHLH) transcription factor involved in inter-organelle communication between mitochondria, peroxisomes, and nucleus |
| 100 | YJL127C | (SPT10) | 4.01528284 | 7.83944269 | 10.0960266 | Protein that amplifies the magnitude of transcriptional regulation at various loci |
| 111 | YMR037C | (MSN2) | 6.80686734 | 6.42359685 | 7.66129891 | Zinc-finger transcriptional activator for genes involved in the multistress response and genes regulated through SNF1P |
| 118 | YCR048W | (ARE1) | 9.11370518 | 6.1039374 | 10.5312906 | Acyl-COA:sterol acyltransferase (sterol-ester synthetase) |
| 131 | YAL013W | (DEP1) | 8.79366086 | 5.54633863 | 6.42500999 | Regulator of phospholipid metabolism |
| 132 | YIL084C | (SDS3) | 1.99582364 | 5.54306878 | 6.90742248 | Suppresor of silencing defect |
| 157 | YKR034W | (DAL80) | 3.91750209 | 5.0436172 | 7.28385659 | GATA-type zinc finger transcriptional repressor for allantoin and 4-aminobutyric acid (GABA) catabolic genes |
| 172 | YLR098C | (CHA4) | 2.05280928 | 4.75643469 | 5.58664651 | Zinc-finger protein required for activation of CHA1, has A ZN[2]-CYS[6] fungal-type binuclear cluster domain |
| 180 | YDR389W | (SAC7) | 3.89197011 | 4.56095992 | 4.31431086 | GTPase-activating protein for RHO1P |

TABLE 3*-continued

| Seq. Num. | Clone ID | ALIAS | CJ-4 hr/ LP-4 hr | K-50/CK | K-100/CK | Gene Description |
|---|---|---|---|---|---|---|
| 202 | YDL088C | (ASM4) | 4.39685251 | 4.17572645 | 3.32103404 | Suppressor of temperature-sensitive mutations in POL3P (DNA polymerase delta) |
| 206 | YBL005W | (PDR3) | 3.75060207 | 4.14490535 | 6.08273054 | Transcription factor related to PDR1P, contains A ZN[2]-CYS[6] fungal-type binuclear cluster domain in the N-terminal region |
| 242 | YGL071W | (RCS1) | 3.39203358 | 3.69630773 | 4.53101664 | Regulatory protein involved in iron uptake |
| 255 | YAR044W | (OSH1) | 4.12112011 | 3.624939 | 3.88396219 | Protein implicated in ergosterol biosynthesis, member of the KES1/HES1/OSH1/YKR003W family of oxysterol-binding (OSBP) proteins |
| 256 | YLR120C | (YAP3) | 6.14265883 | 3.62298451 | 4.42985615 | Transcription factor of the basic leucine zipper (BZIP) family, one of eight members of a novel fungal-specific family of BZIP proteins |
| 260 | YJR017C | (ESS1) | 2.98118086 | 3.55874146 | 3.22082555 | Processing/termination factor, involved in transcription termination or 3'-end processing of pre-MRNA |
| 271 | YMR019W | (STB4) | 3.2576922 | 3.44146214 | 3.39764598 | SIN3P-binding protein, has ZN[2]-CYS[6] fungal-type binuclear cluster domain in the N-terminal region |
| 278 | YLR153C | (ACS2) | 3.45528019 | 3.37854457 | 3.12858117 | Acetyl-COA synthetase (acetate-COA ligase) |
| 289 | YPL119C | (DBP1) | 5.87199247 | 3.24642228 | 2.19736599 | ATP-dependent RNA helicase of dead box family, suppressor of SPP81/DED1 |
| 290 | YGL014W | — | 3.11296478 | 3.22942947 | 3.6382821 | Protein with pumilio repeats that is involved with MPT5P in relocalization of SIR3P and SIR4P from telomeres to the nucleolus |
| 296 | YGL192W | (IME4) | 2.89030953 | 3.17038103 | 6.47841053 | Positive transcription factor for IME1 and IME2, mediates control of meiosis by carrying signals regarding mating type (A/alpha) and nutritional status |
| 297 | YMR047C | (NUP116) | 2.56622055 | 3.17022339 | 4.77420515 | Nuclear pore protein (nucleoporin) of the GLFG family, may be involved in binding and translocation of nuclear proteins |
| 301 | YLR249W | (YEF3) | 3.59397167 | 3.14453335 | 2.63195398 | Translation elongation factor EF-3A, member of ATP-binding cassette (ABC) superfamily |
| 322 | YOR337W | (TEA1) | 2.13152473 | 2.97907151 | 4.82285812 | TY1 enhancer activator of the GAL4P-type family of DNA-binding proteins |
| 331 | YCR084C | (TUP1) | 2.40138822 | 2.92198431 | 3.27182635 | General repressor of transcription (with SSN6P), member of WD (WD-40) repeat family |
| 336 | YPL226W | — | 2.45263084 | 2.88856775 | 2.55579443 | Protein with similarity to members of the ATP-binding cassette (ABC) superfamily |
| 345 | YJR019C | (TES1) | 4.07777555 | 2.83032346 | 2.07248965 | Acyl-COA thioesterase |
| 346 | YBL008W | (HIR1) | 7.24580603 | 2.82847131 | 2.88668127 | Histone transcription inhibitor, required for periodic repression of 3 of the 4 histone gene loci and for autogenous repression of HTA1-HTB1 locus by H2A and H2B |
| 349 | YGL001C | — | 3.91981575 | 2.82148161 | 1.98527852 | Protein with similarity to nocardia SP, cholesterol dehydrogenase |
| 359 | YCL037C | (SRO9) | 8.35007693 | 2.78557477 | 2.39358801 | Suppressor of YPT6 null and RHO3 mutations |
| 367 | YDR088C | (SLU7) | 2.07293165 | 2.73396273 | 2.68767436 | Pre-MRNA splicing factor affecting 3' splice site choice, required only for the second catalytic step of splicing |
| 376 | YBR289W | (SNF5) | 2.00671327 | 2.68812945 | 3.03861899 | Component of SW1/SNF global transcription activator complex, acts to assist gene-specific activators through chromatin remodeling |

TABLE 3*-continued

| Seq. Num. | Clone ID | ALIAS | CJ-4 hr/ LP-4 hr | K-50/CK | K-100/CK | Gene Description |
|---|---|---|---|---|---|---|
| 400 | YPL237W | (SUI3) | 2.5966981 | 2.5628077 | 2.54794558 | Translation initiation factor EIF2beta subunit |
| 406 | YOR127W | (RGA1) | 3.85804733 | 2.53166489 | 2.56973414 | RHO-type GTPase-activating protein (GAP) for CDC42P |
| 416 | YFR009W | (GCN20) | 2.63782118 | 2.48595438 | 2.16133777 | Component of a protein complex required for activation of GCN2P protein kinase in response to amino acid starvation, member of ATP-binding cassette (ABC) superfamily |
| 417 | YDR211W | (GCD6) | 2.22567451 | 2.48354852 | 1.82406386 | Translation initiation factor EIF2B (guanine nucleotide exchange factor), 81 KDA (beta) subunit |
| 440 | YGR270W | (YTA7) | 2.68803581 | 2.4056715 | 1.94575504 | Protein with similarity to members of the AAA family of ATPases |
| 441 | YBR119W | (MUD1) | 2.83912216 | 2.40515252 | 1.39876418 | U1 SNRNP A protein (SNRNA-associated protein) with 2 RNA recognition (RRM) domains |
| 442 | YDR052C | (DBF4) | 6.85835185 | 2.40369283 | 1.58349756 | Regulatory subunit for CDC7P protein kinase, required for G1/S transition |
| 492 | YPR080W | (TEF1) | 2.50402057 | 2.21150946 | 1.85878786 | Translation elongation factor EF-1alpha (TEF1 and TEF2 code for identical proteins) |
| 496 | YDR264C | (AKR1) | 3.13151279 | 2.19839665 | 2.75165355 | Ankyrin repeat-containing protein that has an inhibitory effect on signaling in the pheromone pathway |
| 503 | YDR422C | (SIP1) | 2.62373247 | 2.18707608 | 2.08363472 | Multicopy suppressor of SNF1, related to GAL83P/SPM1P and SPM2P |
| 504 | YMR080C | (NAM7) | 2.82340116 | 2.1825046 | 2.17148277 | Protein involved with NMD2P and UPF3P in decay of MRNA containing nonsense codons |
| 515 | YAL048C | — | 5.02313141 | 2.13847476 | 4.22113197 | Protein with weak similarity to RAS1P, RAS2P, and other GTP binding proteins of the RAS superfamily |
| 526 | YHL027W | (RIM101) | 2.57210755 | 2.10331571 | 2.59278915 | Zinc-finger protein involved in induction of IME1 |
| 531 | YGL112C | (TAF60) | 2.21463331 | 2.07652653 | 2.18913076 | Component of TAF(II) complex (TBP-associated protein complex) required for activated transcription by RNA polymerase II |
| 549 | YPL028W | (ERG10) | 2.86559138 | 2.01859514 | 1.69893374 | Acetyl-COA acetyltransferase (acetoacetyl-COA thiolase), first step in mevalonate/sterol pathway |
| 621 | YNR019W | (ARE2) | 2.1 | 1.79103463 | 2.85442 | Acyl-COA:sterol acyltransferase (sterol-ester synthetase) |
| 560 | YFL054C | — | 7.43223753 | 0.47935821 | 0.61365816 | Protein with similarity to FPS1P and YPR192P, member of MIP family of transmembrane channels |
| 562 | YAL001C | (TFC3) | 2.94740587 | 0.47427458 | 1.19155655 | RNA polymerase transcription initiation factor TFIIIC (TAU), 138 KDA subunit |
| 579 | YIR017C | (MET28) | 2.97658904 | 0.3775372 | 0.30088953 | Transcriptional activator of the basic leucine zipper (BZIP) family, works with MET4P and CBF1P to regulation sulfur amino acid metabolism |
| 585 | YDR253C | (MET32) | 2.86314943 | 0.33971751 | 0.32790428 | Zinc-finger protein involved in transcriptional regulation of methionine metabolism |
| 595 | YMR146C | (TIF34) | 5.0351989 | 0.22482039 | 0.71935381 | Translation initiation factor EIF3, P39 subunit, has 2 WD (WD-40) repeats |
| 616 | YGR083C | (GCD2) | 2.32134339 | 0 | 0 | Translation initiation factor EIF2B (guanine nucleotide exchange factor), 71 KDA (delta) subunit |

TABLE 3*-continued

| Seq. Num. | Clone ID | ALIAS | CJ-4 hr/ LP-4 hr | K-50/CK | K-100/CK | Gene Description |
|---|---|---|---|---|---|---|
| 610 | YOR139C | (SFL1) | 5.46648132 | 0 | 11.7609951 | Transcription factor with domains homologous to MYC oncoprotein and yeast HSF1P, required for normal cell surface assembly and flocculence |

*Table Headings:
Clone ID: A clone ID designation number.
CJ-4 hr/LP-4 hr: Expression level in the mutant CJ517 as compared with the respective wild type strain LPY9 at 4 hr sampling of log phase growth of yeast (ratio of mutant expression level/control expression level). Genes in the Table are either up or down regulated in the mutant (CJ517) as well as in response to ketoconazole treatment.
K-50/CK: Expression level in the wild type yeast LPY9, at 2 hr after treatment with 50 micro gram/ml ketoconazole as compared to the wild type LPY9 strain without ketoconazole treatment (ratio of treatment expression level/control expression level).
K-100/CK: Expression level in the wild type yeast LPY9, at 2 hr after treatment with 100 micro gram/ml ketoconazole as compared to the wild type LPY9 strain without ketoconazole treatment (ratio of treatment expression level/control expression level).
Gene Description: Description of the clone listed in column 1.

In addition, for example, Table 2 identifies a yeast HES1 gene as a gene with an associated change in mRNA levels in the two different comparisons. Fang et al. *EMBO J* 15:6447–59 (1996), the entirety of which is herein incorporated by reference, reported a mutation in HES1, which caused a 55% reduction in carbon flux through the mevalonate pathway in yeast.

Each of the sequences listed in Table 2 or 3 represents a gene that effects sterol levels, directly or indirectly, or whose expression changes as a result of alterations in the sterol synthesis pathway.

EXAMPLE 2

Sequences that encode for the yeast HES1 protein are used to search databases for homologues from other species. A number of different databases can be used for these searches, including, for example, dbEST, GenBank, EMBL, SwissProt, PIR, and GENES. In addition, various algorithms for searching can be selected, such as, for example, the BLAST suite of programs at the default values. Typically, matches found with BLAST P values equal or less than 0.001 (probability) or BLAST Score of equal or greater than 90 are classified as hits. If the program used to determine the hit is HMMSW then the score refers to HMMSW score. The GenBank database is searched with BLASTN and BLASTX (default values). Sequences that pass the hit probability threshold of $10c^{-8}$ are considered hits.

TABLE 4

| Seq. Num. | Clone ID | Sequence: DNA/Protein | Hit description | Library |
|---|---|---|---|---|
| 1 | 701100307CPR9855 | DNA | Yeast HES 1 homolog | SOYMON028 |
| 2 | 701001443CPR9857 | DNA | Yeast HES 1 homolog | SOYMON018 |
| 3 | 701010572CPR9854 | DNA | Yeast HES 1 homolog | SOYMON019 |
| 4 | 701176735CPR9736 | DNA | Yeast HES 1 homolog | SATMONN05 |
| 5 | Z75145 | DNA | Protein implicated in ergosterol biosynthesis, member of the KES1/HES1/OSH1/YKR003W family of oxysterol-binding (OSBP) proteins | — |
| 622 | 701100307CPR9855 | Protein | Yeast HES 1 homolog | SOYMON028 |
| 623 | 701001443CPR9857 | Protein | Yeast HES 1 homolog | SOYMON018 |
| 624 | 701010572CPR9854 | Protein | Yeast HES 1 homolog | SOYMON019 |
| 625 | 701176735CPR9736 | Protein | Yeast HES 1 homolog | SATMONN05 |
| 626 | Z75145 | Protein | Protein implicated in ergosterol biosynthesis, member of the KES1/HES1/OSH1/YKR003W family of oxysterol-binding (OSBP) proteins | — |
| 6 | 701003888H1 | DNA | Yeast HES 1 homolog | SOYMON019 |
| 7 | 701001351H1 | DNA | Yeast HES 1 homolog | SOYMON018 |
| 8 | 700672545H1 | DNA | Yeast HES 1 homolog | SOYMON006 |
| 9 | 700664054H1 | DNA | Yeast HES 1 homolog | SOYMON005 |
| 10 | 700665644H1 | DNA | Yeast HES 1 homolog | SOYMON005 |
| 11 | 700764248H1 | DNA | Yeast HES 1 homolog | SOYMON020 |
| 12 | 700851444H1 | DNA | Yeast HES 1 homolog | SOYMON023 |
| 13 | 700971910H1 | DNA | Yeast HES 1 homolog | SOYMON005 |
| 14 | 700652932H1 | DNA | Yeast HES 1 homolog | SOYMON003 |
| 15 | 700982894H1 | DNA | Yeast HES 1 homolog | SOYMON009 |
| 16 | 701120140H1 | DNA | Yeast HES 1 homolog | SOYMON037 |
| 17 | 701064234H1 | DNA | Yeast HES 1 homolog | SOYMON034 |
| 18 | 700954013H1 | DNA | Yeast HES 1 homolog | SOYMON022 |
| 19 | 701129375H1 | DNA | Yeast HES 1 homolog | SOYMON037 |
| 20 | 701043941H1 | DNA | Yeast HES 1 homolog | SOYMON032 |
| 21 | LIB24-114-Q1-E1-H8 | DNA | Arabidopsis HES 1 homolog | LIB24 |
| 22 | LIB22-016-Q1-E1-F3 | DNA | Arabidopsis HES 1 homolog | LIB22 |
| 23 | LIB25-101-Q1-E1-F1 | DNA | Arabidopsis HES 1 homolog | LIB25 |

TABLE 4-continued

| Seq. Num. | Clone ID | Sequence: DNA/Protein | Hit description | Library |
|---|---|---|---|---|
| 24 | AA042357 | DNA | Arabidopsis HES 1 homolog | — |
| 25 | AA720163 | DNA | Arabidopsis HES 1 homolog | — |
| 26 | Z29936 | DNA | Arabidopsis HES 1 homolog | — |
| 27 | T76850 | DNA | Arabidopsis HES 1 homolog | — |
| 28 | T76580 | DNA | Arabidopsis HES 1 homolog | — |
| 29 | AA586043 | DNA | Arabidopsis HES 1 homolog | — |

Homologues to yeast HES1 are also identified in the following libraries: SOYMON003, SOYMON005, SOYMON006, SOYMON009, SOYMON018, SOYMON019, SOYMON020, SOYMON022, SOYMON028, SOYMON023, SOYMON032, SOYMON034, SOYMON027, SATMONN05, LIB22, LIB 24, and LIB 25. These libraries are prepared as follows:

The SATMONN05 cDNA library is a normalized library generated from maize (B73 x Mo17, Illinois Foundation Seeds, Champaign Ill., U.S.A.) root tissue at the V6 development stage. Seeds are planted at a depth of approximately 3 cm into 2–3 inch peat pots containing Metro 200 growing medium. After 2–3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation. The RNA is purified from the stored tissue. The library is normalized in two rounds using conditions adapted from Soares et al., *Proc. Natl. Acad. Sci. (U.S.A.)* 91:9928 (1994), the entirety of which is herein incorporated by reference and Bonaldo et al., *Genome Res.* 6: 791 (1996), the entirety of which is herein incorporated by reference except that a significantly longer (48-hours/round) reannealing hybridization was used. SATMON003 is a root tissue library from the same donor.

The SOYMON003 cDNA library is generated from soybean cultivar Asgrow 3244 (Asgrow Seed Company, Des Moines, Iowa U.S.A.) hypocotyl axis tissue from seedlings 2 day after-imbibition. Seeds are planted at a depth of approximately 2 cm into 2–3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of an) adhering seed coat. At 2 days after imbibition under the above conditions, the seedlings have significant expansion of the axis and are close to emerging from the soil. A few seedlings have cracked the soil surface and exhibited slight greening of the exposed cotyledons. The seedlings are washed in water to remove soil, hypocolyl axis harvested and immediately frozen in liquid nitrogen. The harvested tissue is then stored at −80° C. until RNA preparation. The RNA is purified from the stored tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON005 cDNA library is generated from soybean cultivar Asgrow 3244 (Asgrow Seed Company, Des Moines. Iowa U.S.A.) hypocotyl axis tissue from seeds 6 hour post-imbibition. Seeds are planted at a depth of approximately 2 cm into 2–3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after the start of imbibition. The 6 hours after imbibition sample is collected over the course of approximately 2 hours starting at 6 hours post imbibition. At the 6 hours after imbibition stage, not all cotyledons have become fully hydrated and germination. Radicle protrusion has not occurred. The seedlings are washed in water to remove soil, then the hypocotyl axis is harvested and immediately frozen in liquid nitrogen. The harvested tissue is then stored at −80° C. until RNA preparation. The RNA is purified from the stored tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON006 cDNA library is generated from soybean cultivar Asgrow 3244 (Asgrow Seed Company. Des Moines, Iowa U.S.A.) cotyledons from seeds 6 hour post-imbibition. Seeds are planted at a depth of approximately 2 cm into 2–3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after imbibition. The 6 hours after imbibition sample is collected over the course of approximately 2 hours starting at 6 hours post-imbibition. At the 6 hours after imbibition, not all cotyledons have become fully hydrated and germination. Radicle protrusion has not occurred. The seedlings are washed in water to remove soil, then the cotyledon is harvested and immediately frozen in liquid nitrogen. The harvested tissue is then to stored at −80° C. until RNA preparation. The RNA is purified from the stored tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynaheads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON009 cDNA library is generated from soybean cultivar C1944 (USDA Soybean Germplasm Collection, Urbana, Ill. U.S.A.) pod and seed tissue harvested 15 days post-flowering. Pods from field grown plants are harvested 15 days post-flowering. The pods are picked from all over the plant, placed into 14 ml polystyrene tubes and immediately immersed in dry-ice. Approximately 3 g of pod tissue is harvested. The harvested tissue is then stored at −80° C. until RNA preparation. The RNA is purified from the stored tissue and the cDNA library is constructed. The RNA is purified from the stored tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON018 cDNA is generated from soybean cultivar Asgrow 3244 (Asgrow Seed Company, Des Moines, Iowa U.S.A.) leaf tissue harvested from plants grown in a field in Jerseyville 45 and 55 days after flowering. Leaves from field grown plants are harvested 45 and 55 days after flowering from the fourth node. Approximately 27 g and 33 g of leaves are collected from the 45 and 55 days after flowering plants, placed into 14 ml polystyrene tubes and immediately immersed in dry ice. The harvested tissue is then stored at −80° C. until RNA preparation. Total RNA is prepared from the combination of equal amounts of leaf tissue from both time points and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON019 cDNA library is generated from soybean cultivars Cristalina (USDA Soybean Germplasm Collection, Urbana, Ill. U.S.A.) and Fr108 (Monsoy, Brazil) (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The plants are uprooted and the roots quickly rinsed in a pail of water. The root tissue is then cut from the plants, placed immediately in 14 ml polystyrene tubes and immersed in dry-ice. The harvested tissue is then stored at −80° C. until RNA preparation. Total RNA is prepared from the combination of equal amounts of root tissue from each cultivar and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON020 cDNA is generated from soybean cultivar Asgrow 3244 (Asgrow Seed Company, Des Moines, Iowa U.S.A.) seeds harvested from plants grown in a field in Jerseyville 65 and 75 days post-flowering. The seed pods are picked from all over the plant and the seeds extracted from the pods. Approximately 14 g and 31 g of seeds are harvested from the respective seed pods and immediately frozen in dry ice. The harvested tissue is then stored at −80° C. until RNA preparation. Total RNA is prepared from the combination of equal numbers of seeds from 65 and 75 days after flowering and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON022 cDNA library is generated from soybean cultivar Asgrow 3244 (Asgrow Seed Company, Des Moines, Iowa U.S.A.) partially to fully opened flower tissue, which is harvested from plants grown in an environmental chamber. Seeds are planted in moist Metromix 350 medium at a depth of approximately 2 cm. Trays are placed in an environmental chamber set to a 12 h day/12 h night cycle, 29° C. daytime temperature, 24° C. night temperature and 70% relative humidity. Daytime light levels are measured at 450 μEinsteins/m². Soil is checked and watered daily to maintain even moisture conditions. Flowers are removed from the plant at the pedicel. Flower buds showing petal color to fully open flowers are selected for collection. A total of 3 g of flower tissue is harvested and immediately frozen in dry ice. The harvested tissue is then stored at −80° C. until RNA preparation. Total RNA is prepared from a mixture of opened and partially opened flowers and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON023 cDNA library is generated from soybean genotype BW211S Null (Tohoku University, Morioka, Japan) seed tissue harvested from plants grown in a field in Jerseyville. After 15 and 40 days, pods are harvested from all over the plant and seeds are dissected out from the pods. Approximately, 0.7 g and 14.2 g of seeds are harvested from the plants at the 15 and 40 days after flowering timepoints. The seeds are placed into 14 ml polystyrene tubes and immersed in dry-ice. The tissue is then transferred to a −80° C. freezer for storage. The harvested tissue is then stored at −80° C. until RNA preparation. Total RNA is prepared from the combination of 0.5 g and 1.0 g of seeds from the 15 and 40 days after flowering timepoints and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON028 cDNA library is generated from soybean cultivar Asgrow 3244 (Asgrow Seed Company, Des Moines, Iowa U.S.A.) drought-stressed root tissue. Seeds are planted in moist Metromix 350 medium at a depth of approximately 2 cm in trays. The trays are placed in an environmental chamber set to a 12 h day/12 h night cycle, 26° C. daytime temperature. 21° C. night temperature and 70% relative humidity. Daytime light levels are measured at 300 μEinsteins/m². Soil is checked and watered daily to maintain even moisture conditions. At the R3 stage of development, water is withheld from half of the plant collection (drought stressed population). After 3 days, half of the plants from the drought stressed condition and half of the plants from the control population are harvested. After another 3 days (6 days post drought induction) the remaining plants are harvested. A total of 27 g and 40 g of root tissue is harvested from plants at two time points and immediately frozen in dry ice. The harvested tissue is then stored at −80° C. until RNA preparation. Total RNA is prepared from the combination of equal amounts of drought stressed root tissue from both time points and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON032 cDNA library is prepared from the Asgrow cultivar A4922 (Asgrow Seed Company, Des Moines, Iowa U.S.A.) rehydrated dry soybean seed meristem tissue. Surface sterilized seeds are germinated in liquid media for 24 hours. The seed axis is then excised from the barely germinating seed, placed on tissue culture media and incubated overnight at 20° C. in the dark. The supportive tissue is removed from the explant prior to harvest. Approximately 570 mg of tissue is harvested and frozen in liquid nitrogen. The harvested tissue is then stored at −80° C. until RNA preparation. The RNA is purified from the stored tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON034 cDNA library is generated from soybean cultivar Asgrow 3244 (Asgrow Seed Company, Des Moines, Iowa U.S.A.) cold-shocked seedling tissue without cotyledons. Seeds are imbibed and germinated in vermiculite for 2 days under constant illumination (ca. 510 Lux). After 48 hours, the seedlings are transferred to a cold room set at 5° C. under constant illumination (ca. 560 Lux). After 30, 60 and 180 minutes seedlings are harvested and dissected. The seedlings after 2 days of imbibition are beginning to emerge from the vermiculite surface. The apical hooks are dark green in appearance. A portion of the seedling consisting of the root, hypocotyl and apical hook is frozen in liquid nitrogen and stored at −80° C. Total RNA is prepared from equal amounts of pooled tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The SOYMON037 cDNA library is generated from soybean cultivar A3244 (Asgrow Seed Company, Des Moines, Iowa U.S.A.) etiolated axis and radical tissue. Seeds are planted in moist vermiculite, wrapped and kept at room temperature in complete darkness until harvest. Etiolated axis and hypocotyl tissue is harvested at 2.3 and 4 days post-planting. Samples are frozen in liquid nitrogen upon harvesting and stored at −80° C. until RNA preparation. 1 gram of each sample (axis+hypocotyl at day 2.3 and 4) is pooled for RNA isolation. The RNA is purified from the pooled tissue and the cDNA library is constructed.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The cDNA library of the present invention designated LIB22, is prepared from Arabidopsis thaliana Columbia ecotype root tissue. Wild type Arabidopsis thaliana seeds are planted in commonly used planting pots and grown in an environmental chamber. After 5–6 weeks the plants are in the reproductive growth phase. Stems are bolting from the base of the plants. After 7 weeks, more stems and floral buds appear, and a few flowers are starting to open. Roots of 7-week old plants from pots are rinsed intensively with tap water to wash away dirt, and briefly blotted by paper towel to take away free water. The tissues are immediately frozen in liquid nitrogen and stored at −80° C. until total RNA extraction.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The cDNA library of the present intention designated LIB24, is prepared from Arabidopsis thaliana, Columbia ecotype, flower bud tissue. Wild type Arabidopsis thaliana seeds are planted in commonly used planting pots and grown in an environmental chamber. Flower buds are green and unopened and are harvested about seven weeks after planting. The tissue is immediately frozen in liquid nitrogen and stored at −80° C. until total RNA extraction.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

The cDNA library of the present invention designated LIB25, is prepared from Arabidopsis thaliana, Columbia ecotype, open flower tissue. Wild type Arabidopsis thaliana seeds are planted in commonly used planting pots and grown in an environmental chamber. Flower are completely opened with all parts of floral structure observable, but no siliques are appearing, and are harvested about seven weeks after planting. The tissue was immediately frozen in liquid nitrogen and stored at −80° C. until total RNA extraction.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-know n in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

EXAMPLE 3

Detection of Changes in Sterol Metabolism

A labeled acetyl-CoA molecule, squalene molecule, or acetate are used in a variety of assays to detect changes in sterol production, secretion, localization, protein-binding, degradation, and trafficking known in the art. The example below illustrates.

Cells from transformed plants are cultured in an appropriate medium. Labeled acetate, preferably $^{14}$C-labeled, is added to a concentration of about 1 uCi/ml. After a period of growth, the cells are collected, the lipids extracted, and resolved by thin-layer chromatography or run over HPLC column using known methods. The levels of each sterol resolved can be compared to control cells fed the same labeled $^{14}$C acetate and the amount of $^{14}$C-labeled sterol for each determined from the resolved sterols.

REFERENCES

In addition to those references cited and incorporated by reference above, the below references are incorporated in their entirety. In addition, these references, as well as each of those cited in the Summary and Detailed Description above, can be relied upon to make and use aspects of the invention.

Jiang, et al., A new family of yeast genes implicated in ergosterol synthesis is related to the human oxysterol-binding protein. *Yeast* 10: 341–53 (1994).

Fang, et al., Kes1p shares homology with human oxysterol-binding protein and participates in a novel regulatory pathway for yeast Golgi-derived transport vesicle biogenesis. *EMBO J.* 15: 6447–59(1996).

Crowley, et al., A mutation in a purported regulatory gene affects control of sterol uptake in *Saccharomyces cerevisiae*, *Journal of Bacteriology*, 180(16): 4177–83 (1998).

Casperand Holt, Expression of the green fluorescent protein-encoding gene from a tobacco mosaic virus-based vector. *Gene*, 173: 69–73 (1996).

SEQUENCE LISTING (626 sequences)

SEQ ID NO: 1 - DNA, 1358 bp, Glycine max
  CDS (24)...(1100)
gaattcggctcgagtttgaaccaatgacaatgcttcagaaaatggctgagcttatggagtactcttacctgttagatatggcggacaagactgaggatccatacatgagactagtatatgcttcatcattctttatatctgtctactatgcctatcaacgaacgtggaagccattcaatccaattcttggtgagacttatgaaatggttaaccatggtggcattacatttatatcagagcaggtcagtcatcaccctccaatgagtgctgggcatgctgaaactgaacatttcacttatgatgttacatcaaaattgaaaaccaaatttctcggcaactcagttgatgtatatcctgttggaagaacgcgtgttaccctcaaaagagatggtgtggtccttgatttggtgcctcctcctacaaaagttagcaacttgatttttggacgaacttggattgattcaccaggagagatgatcctgacaaatctgactacaggggacaaagtggtgctgtattttcaaccatgtggctggtttggatatgaagtggatgggtacgtgtataattctgctgacgagcctaagatactgatgactggaaaatggaatgaggctatgaattatcaagtttgtgactcagagggagaaccacttccaggcactgagttgaaagagatttggagagttgctgataccccgaagaaggacaagttccagtacacgcattttgcacacaagattaacagctttgacactgctcccaagaagttgttggcatctgactctcgtctacgtcctgatagaatggcccttgagaagggtgacctatccacatctggttatgagaagagcagtttggaggagaggcaaagagctgagaagagaaaccgagaggccaagggccataagttcactcctagatggtttgatttaacagatgaagtaactcctaccccttggggtgacttggaagtttaccaatacaacggtaaatatacccaacattgtgctgccgttgatagttctgagtgcattgaagtgcctgacatcagaccagaattcaacccttggcaatatgataatttggatgctgaatagtgagcatccttgtggaattctttctattttttttaaatatcattttgttattaagtttgtaatgtaatcttgattggaatgcttgaaatttggttttgtttttgggttgttttatcactgtagtatttgattaattaatagtagctatgttagttcatcagttcactttgcatggataaatgctagtagggaaattaaagttatcttccaaaaaaaaaaaaaaaaaaaaaaaaaaaaaaaaaaaaagggcggccgccg

SEQ ID NO: 2 - DNA, 1136 bp, Glycine max
  CDS (73)...(975)
gaattcggctcgaggtcacaacttcagtgctatggtgaatcagtgtattgcacaggttcggacttgctaagcatgtgcaacaatggtcagagtccacttgataggttcatatctgtggtagcatggtgcatatctaccactcgccctgtgacttttggtgttgctccttataatcccattcttggtgagacacaccatgtttcaaggggaaatcttaatgtgttattggagcagatttcacatcaccctccagtaactgctctccatgcaacagatgagaaggaaaacattgaaatgttatggtgccagcgacctgatccaaagtttaatggcacatcagttgaagctaaagtgcatggaatacgccagttgaagctcctaaatcatggtgaaacatatgaaatgaattgtcctcgccttttacttagaattcttccagttcctggtgctgattgggctggtacagttaatatacggtgcctagagacaggtctagtagctgaattatcctacagatcaagttcttttctaggaattggggggaatcatagagtgatcaaagggaagatccttgactcttcatcattgaaagttctatatgaagttgatggtcattgggataggaccgtaaaagtgaaggacacaaataatgggaaagtaagagtgatatatgatgcaaaggaagttatgtcaggtctcgaaactcctatactcaaggacatagagggtgtgtggcaaacagaatcagctcatgtttggggtgaattaaaccaagccattgtgagcaaagactgggagaaagcaagagaagcaaagctaaaagttgaggaaagacaaagggagcttgtgagagaaagagaatcaaaaggagaaacatggatttctaagcattttgtagtttctaacaacaaagaagggtggcaatgttcacctattcataagagtgtacctgcggcccccatcacagccctataattgttgtcactgtcaagtagtgtaaagcattaaagtacattttagaagagaatgttcataaaaaaatttaatggttgaaattttgacaacaatgaagtatataacaaaatttaaaattagttacaattttaaaaaaaaaaaaaaaaaaagggcggccgccg

SEQ ID NO: 3 - DNA, 1355 bp, Glycine max
  CDS (32)...(1099)
ggaattcggctcgaggacaatgcttcagaaaatggctgagcttatggagtactcttacctgttagatatggcggacaagactgaggatccatacatgagactagtatatgcttcatcattctttatatctgtctactatgcctatcaacgaacgtggaagccattcaatccaattcttggtgagacttatgaaatggttaaccatggtggcattacatttatatcagagcaggtcagtcatcaccctccaatgagtgctgggcatgctgaaactgaacatttcacttatgatgttacatcaaaattgaaaaccaaatttctcggcaactcagttgatgtatatcctgttggaagaacgcgtgttaccctcaaaagagatggtgtggtccttgatttggtgcctcctcctacaaaagttagcaacttgatttttggacgaacttggattgattcaccaggagagatgatcctgacaaatctgactacaggggacaaagtggtgctgtattttcaaccatgtggctggtttggagctggtagatatgaagtggatgggtacgtgtataattctgctgacgagcctaagatactgatgactggaaaatggaatgaggctatgaattatcaagtttgtgactcagagggagaaccacttccaggcactgagttgaaagagatttggagagttgctgataccccgaagaaggacaagttccagtacacgcattttgcacacaagattaacagctttgacactgctcccaagaagttgttggcatctgactctcgtctacgtcctgatagaatggcccttgagaagggtgacctatccacatctggttatgagaagagcagtttggaggagaggcaaagagctgagaagagaaaccgagaggccaagggccataagttcactcctagatggtttgatttaacagatgaagtaactcctaccccttggggtgacttggaagtttaccaatacaacggtaaatatacccaacattgtgctgccgttgatagttctgagtgcattgaagtgcctgacatcagaccagaattcaacccttggcaatatgataatttggatgctgaatagtgagcatccttgtggaattctttctatttttttgaaatatcattttgttattaagtttgtaatgtaatcttgattggaatgcttgaaatttggttttgtttttgggttgttttatcactgtagtatttgattaattaatagtagctatgttagttcatcagttcactttgcatggataaatgctagtagagaaattaaagttaaaaaaaaaaaaaaaaaaaaaaaaaaaaaaaaaaaaaaaaaagggcggccgccg

SEQ ID NO: 4 - DNA, 1422 bp, Zea mays
  CDS (1)...(1245)
atggctaccaaagaagaagctagcgctgtccccgccgccagtaaaacttcatggagtagcttcctgaagtccatcgcatccttcaacggcgacctctcctctctcaccgcaccgccgttcatcctctcaacaacctctttaaccgagtattctgcgtactggtgcgaacatcctgcactcttcgttgcccccgcacgtgagcccgatcctgcgaagagagcgctcttggtgctgaaatggttcctgagcacattgcaccaacagtactgctctcgaagcgaaaagctaggaagcgagaaaaagccgctcaacccgttcctgggcgagcttttcctgggcaagtggatagaggatgaggatgtgggcgagacaaggttgatcagcgagcaagtcagccatcatcctcctgcgacagcgtattcaatagtcaatgagaaacatggagttgagctccaaggatacaacgcccaaaaagcctccttctccagcaccatccaagtgaaacaactaggccacgcctatctctccttaacgccgcccggaaaagatgcaaacaacgaagacgaccgtgagcactacctcatcaccctccccaacctccacatcgaatccctgatctatgggacaccattcgttgaattggaaaagagttgcaagatcgccagctcaaccgggtacatctctaagatagacttttcgggcaaaggctggctgagcggaaagaaaaataccttctccgcagtgttatacaaggaaagcgacggcgaaaaaaatcctttatacacagccgacggtcaatggtcgagcagcttcactatccgcgatgcacgcgctaagaaggatattgagaccttcactatcagcaatctgaaaacaacccccttaacagtcgcccctcttgatgaacaagatgaatgggaaactcgccgtgcatggcgcgacgtagcagccgccatcgaacgcggcgacatggaagccacatcaaacgccaaaaccaagatcgaagtcgcgcaacgagaactccgcaaaaaggagaaagagcaaggcgaggagtgggaacgacgattcttcaagcgagtcaacgaaaaggatgaacctacctttatgagattggcggcgatgctggatttgacgcaaggcatcgaaagtgaccgcaccgggggagtttggaggtttgatccttcacgtgctgtggatgcgaatccgccgtatcacaaggttggcggcgaagggttgggattgtaatttatttatgaggcatcttttatatttcataaaaacagggtctaggccgtttattcattaaatgtgtattaagtagcgctttttctcgaccgttgagattcatggatgcaagtgtacctaatagctcaatgcgagactctttccaagcaaaaaaaaaaaaaaaaaaagggcggccgc

SEQ ID NO: 5 - DNA, 2126 bp, Saccharomyces cerevisiae
  CDS (453)...(1757)
aacctctccgcccgtatattttttttaatatgttaaatagtgatagaactgataagcctcattttcttttattgggctccaagacgcgaactgttcgtagggtaaccgtttgacacctaaacgacctttcagcctcacctgcagtatttcttcaacaacgcctgtcgctatgttaaataatagcaatcgtttgtgatcaccattgtcgaatttgacgcgcttaaacaaaaaccattgttttggcctcgttccctgcattcaacaaaagagcaaggtatgccgtcaaacagtcgttaaaagagaaggtttataaactatcttgttttgtactttgctgtcccggatccagttgggtcttcttttcaacctgtctgagtccgatctttctttccctacttgaagctccatatatctaagtcatctaagtgtatcctgctagattacaaacgaaaatgtctcaacacgcaagctcatcttcttggacttcttttttgaaatcgataagttcgttcaacggagatctatcgtctttgtctgcaccaccgtttattctttctcccacttccttaacagagttttctcagtattgggctgaacatccagctttatttctggagccttcgttgattgatggtgaaaactacaaagatcactgtccctttgacccaaatgtggaatcaaaggaagtggcgcagatgttggcggttgttaggtggtttatttctactttgagatctcaatactgctctagaagcgaatcgatgggttctgaaaagaagcctttgaacccattcttgggtgaggtatttgttggaaagtggaaaaatgatgagcatccagagtttggtgaaacggttcttttaagtgagcaagtttcacatcatccacctatgacagcattttcgatttttaatgaaaaaaatgatgtttctgttcaaggatacaatcaaattaaaactggttttaccaaaacattgacgctaacggtcaaaccatacgggcatgtcattttgaagattaaagatgagacctacctgattacaaccccgcctttgcatatcgaaggtattttagtcgcttctccatttgttgaattaggaggcaggtcattcatacagtcatcaaatggtatgttatgtgttatagaattttcaggaagggggtatttcacagggaagaagaactcctttaaggcaagaatttacagaagcccacaagagcatagtcataaagaaaatgcgctatacctaatctctggccaatggtcaggtgtttcaacaattataaaaaaagactcgcaagtttcacatcagttttacgattcatcggaaactcctactgaacatttattagttaagccaatcgaagaacaacatcctctggaaagtaggagggcatggaaggatgtggcagaagcaatcagacaaggaaatattagtatgataaaaaagactaaggaagaactagaaaataagcaaagagccttgagagaacaagaacgcgtaaaaggtgtggaatggcaaagaagatggttcaaacaagtggactacatgaatgaaaatacatcaaatgatgtagagaaagcaagtgaagatgatgcctttaggaaattggcgtccaaactgcagctttctgtgaaaaatgtgccaagtgggacattgattggcggcaaagatgataagaaagatgtttcaaccgcattgcattggaggtttgataaaaatttgtggatgagggagaacgaaattactatataatataaatgtttttaaaagaataaatatcaaaaattaatactaattgatgtttgcattgctttttttaagggaaaatgcaagcgtttttatttttaacttttggttttgaagctcgtaattcaacaaaaaagaattaaataatcttcaagtccgataacaagatgtagaaaaaacatcccaatgaagttacaagtcaaaccattcactgagaatttttgtaactcaccaccgattttttggataaaatgtattcctgcaacttttttttttgaagagataaaaagaattgaatagaatatgcagtaaaaaaagaatctcgaaaaaaaaaggacaagaaatcttaactaccatcaaacaattgaaaattga

SEQ ID NO: 6 - DNA, 266 bp, Glycine max
ccattcaatccaattcttggtgagacttatgaaatggttaaccatggtggcattacatttatatcagagcaggtcagtcatcaccctccaatgagtgctgggcatgctgaaactgaacatttcacttatgatgttacatcaaaattgaaaaccaaatttctcggcaactcagttgatgtatatcctgttggaagaacgcgtgttaccctcaaaagagatggtgtggtccttgatttggtgcctcctcctacaaaagttagcaactt

SEQ ID NO: 7 - DNA, 291 bp, Glycine max
  unsure (1) ... (291): unsure at all n locations
tcacaacttcagtgctatggtgaatcagtgtattgcacaggttcggacttgctaagcatgtgcaacaatggtcagagtccacttgataggttcatatctgtggtagcatggtgcatatctaccactcgccctgtgacttttggtgttgctccttataatcccantcttggtgagacacaccncgtttcaaggggaaatcttaatgtgttattggagcagatttcacatcaccctccagtaactgctctccatgcaacagatgaganggaaaacattgaaatgttatggtgc

SEQ ID NO: 8 - DNA, 282 bp, Glycine max
  unsure (1) ... (282): unsure at all n locations
gtgcccagngacaggtctggtagctgaaatatcatacatgatcaagccattgcttttttaggatttnggggaagtcgtaaattgatcaaagggnaaatccttgactcatnattactcaaaggtctctgcgaagttgatngtcattgggataagatagttagagtgaaggatacnaatagtgnagaagtgagagtgatatatgatgccaaagaagccntttcaggtctcaaaactcctattatcaaggatgtggagagtgtgtggccaaccgaatcagccctt

SEQ ID NO: 9 - DNA, 255 bp, Glycine max
gtaactcctaccccttggggtgacttggaagtttaccaatacaacggtaaatatacccaacattgtgctgccgttgatagttctgagtgcattgaagtgcctgacatcagaccagaattcaacccttggcaatatgataatttggatgctgaatagtgagcatccttgtggaattctttctattttttttaaatatcattttgttattaagtttgtaatgtaatcttgattggaagcttgaaatttggttttgtt

SEQ ID NO: 10 - DNA, 250 bp, Glycine max
taactcctaccccttggggtgacttggaagtttaccaatacaacggtaaatatacccaacattgtgctgccgttgatagttctgagtgcattgaagtgcctgacatcagaccagaattcaacccttggcaatatgataatttggatgctgaatagtgagcatccttgtggaattctttctattttttttaaatatcattttgttattaagtttgtaatgtaatcttgattggaatgcttgaaatttggtt

SEQ ID NO: 11 - DNA, 283 bp, Glycine max
  unsure (1) ... (283): unsure at all n locations
cgcctgtgnttaatttcccaaaatctcaacttcaatgctanggtgaatcagtgtactgcacatcttccaacttgctaagccaatgcaaacagtgggcagagtccactggacaggttcacatcagtagtagcatggagcatatctaccacacgccccacatcttttggtgttgctccttataattccactcttggagagacccaccatgtttccaagggcaatctcaacgtcctagttgagcaggtttcactcaatcctccagtatctgccctccatgcaacag

SEQ ID NO: 12 - DNA, 255 bp, Glycine max
ggagagtgtgtggccaaccgaatcagcccttgtttggagtgagttgagccaagccattatgaacaaagattgggaaagagcaagagaagcaaagcaagacgtggaagaaagacagaggaatatgttgagagacagagccatgaaaggagaaacttggtttcctaagaattttagggtgtcttacagtaaagacacatgggaatgggactgttcaccaactcataaatgggtccctgaggcccccatcatagctca

SEQ ID NO: 13 - DNA, 259 bp, Glycine max
  unsure (1) ... (259): unsure at all n locations
agtcaaccctccagtatctgccctccatgcaacagatgaganggaaaacattgagatgatatggtcccagcaacctgttccaaagtttcggggtacatctatgaagctcaagtgcatggtaaacgtcatatgtttctccatgatttaggagcttcagctgacgtttaccatgcacttgagctgangctcctaaatcatggagaaacatatgaaatgaattgtcctcacctttcaattagaattcttccggttcctggga

SEQ ID NO: 14 - DNA, 355 bp, Glycine max
  unsure (1) ... (355): unsure at all n locations
gcagcttttgctgtgtctagctatgcgtcaactgaangtcgacaatgtaaaccttttaatcctttactcggggagacctacgaagctgactatccagataaaggacttaagtttttttctgaaaaggttagtcatcatccaatgattgttgcttgtcactgtgagggaaggggatggaagttttgggcagattctaatttgaaaggaaaattctgggggcgttctatccagttagatcctgtgggtgtcctcactctacagtttgaggatggtgaaacatttcagtggagcaaggtcaccacttcgatttacaatatcatactangtaaaatttattgtgaccactacggtacca

SEQ ID NO: 15 - DNA, 279 bp, Glycine max
  unsure (1) ... (279): unsure at all n locations
cagattcggaggaggaagctcagagaggaagatggaaacaggaggaaagagatggttactggaagatgatgcagaagtatattggctcggatgtaacatcaatggtgacactaccagttattatatttgaaccaatgactatgattcagaaaattgctgagttgatggagtactcctacttgttagatcaagcagatgaatcagaggatccatacatgcagttagtttatgcaatggatgtacttnatgtatcatcacagcatccatgggccatatcgg

SEQ ID NO: 16 - DNA, 191 bp, Glycine max
gttgatagttctgagtgcatagaggtgcctgacagcagaacagaattcaacccttggcaatatgataatttggatgctgaataataagcatccttgtagaattctttctattctttgaactatcattttgttattaagtttgcaatgtatctgattggaatgcttgaaatttggttttgtttttgggtaaa

SEQ ID NO: 17 - DNA, 267 bp, Glycine max
  unsure (1) ... (267): unsure at all n locations
tcaactccttggggtgatttggaaatctatcaatataatggtaaatacagtgaacatcgagctgctgcagataactcaggaagcattgatgatgttgatgctaaatcaattgaattcaatccatggcagtatggtaatttggccacggaatgaactagtttcaatttctttggttttggatgntncagttagttcatgtaactnttnncnantganacnagaanacaactncctncnncancnnanngttagttgggcngtgtacgc

SEQ ID NO: 18 - DNA, 252 bp, Glycine max
gtcttatagagctcccaatctcctacatcgcttgttaagtttactcaagaacgtgcggccaggatcagatctcacacacttccaactgccagctgtgtttaacttcccaaaatctcaacttcaatgctatggtgaatcagtgtactgcacatcttcaaacttgctgagcaaatgcaacaatgggcagagtccactggacaggttcacatcagtagtagcatggagcatatctaccacacgccccacatcttt

SEQ ID NO: 19 - DNA, 241 bp, Glycine max
gtcagtcatcaccctccaatgagtgctgggcatgctgaaactgaacatttcacttatgatgttacatcaaaattgaaaaccaaatttctcggcaactcagttgatgtatatcctgttggaagaacgcgtgttaccctcaaaagagatggtgtggtccttgatttggtgcctcctcctacaaaagttagcaacttgatttttggacgaacttggattgattcaccaggagagatgatcctga

SEQ ID NO: 20 - DNA, 262 bp, Glycine max
tctcgagcctattcggctcgaggccaaagaagccatttcaggtcactaaactcctattatcatatgatgtggagagtgtgtattcaaccgaatcagcccttgtttggagtgagttgagccaagccattatgaacaaagattgggaaagagcaagagaagcaaagcaagacgtggaagaaagacagaggaatatgttgagagacagagccatgacaggagaaactggttgtctaagaatttagggtgtcttacagtaaagaca

SEQ ID NO: 21 - DNA, 463 bp, Arabidopsis thaliana
  unsure (1) ... (463): unsure at all n locations
ggggaaccccttccaggaacagagctgaaagaggtgtggcatttggctgatgtccccaaaaacgacaactttcagtacactcactttgctcacaagataaacagcttcgacacagcgcctgctaagctcttggcttcagactcacgtatccgtcctgatagatattcccttgagcagggtgacctttctaaagctggttccgagaaacacagccttgaggagagacaaagggccgaaaagaggaccagagagacaaagggacaaaagttcactccaagatggttcgatctaacggatgagatcacacctactccatggggagatattgaagtataccantacaacgggaagtacaatgaacaccgagacacggcagagagctcaagtagtgcctccaacgaaacgggactcaaatccatcgagtttaatccttggcaatatggtaatatctcaaccgaatgaa

SEQ ID NO: 22 - DNA, 399 bp, Arabidopsis thaliana
agtgaacctctcccaggcaccgaactgaaagaggtatggaaactcgctgatgtgccaaaggatgacaaatatcaatacactcactttgctcacaagattaatagcttcgacactgccccgaaaaagctgttgccctctgattcacggttacgacctgatagatacgcacttgagatgggcgacatgtccaaatcaggctatgagaagagcagcatggaagagagacagagagctgacaagagaacccgcgaacataaaggccaagcctttactccaaaatggttcgatgtaacggaagaagtcactgctacaccatggggtgatctggaagtttaccaattcactggaaagtactcagaacatcgtgcagctgcggataactctgaagataagaccgac

SEQ ID NO: 23 - DNA, 343 bp, Arabidopsis thaliana
acggacgcgtgggcaactccaatgttacggcgagatggtctacagcttcgtcggtcaggatctgcttggggaatgcagccgccgtgatcttcccattgaacggctcaaatcagtggtgacgtggaacatctccacactccgtccggtggtctttggcatgtctccgtacaactccgttctcggcgagactcaccacgtatcgaacggtcacatcaacgtcatcgccgaacaagtagtgcatcatcctccggtttccgctcttcatgcgactcacgaacaagaaaatatcgacgtgacatggtgtcaatatttcactcctaaatttcgtggtactcacgtggac

SEQ ID NO: 24 - DNA, 510 bp, Arabidopsis thaliana
  unsure (1) ... (510): unsure at all n locations
gaaagctagcagatgtagaacaaagttttttgtaactacgagagaataagaatacatttgtttccaaaaagatttgatcttttctgtcttttggagcgatacatttaagtagacagatcttggaattgccatgggttgaattggatcgacttagggtcggtgttatcttcagagttatccgcagctgcacgatgttccgagtactttccattgaattggtaaacttccagatcaccccatggtgtagcagtgacttcttccgttacatcgaaccattttggagtaaaggcttggcctttctcttcgcggggtcncttttcaagtctctgtcnctcttccatggtgntcttcccanagcctgatttgnacatggcggccancccaagggnggatcaatcaggccgnaacggggaatcagnnggnaacagcttttcngggnantgncgaagcaataaaccntgggggcaaaggggggggattggaaattggcaacccttggnnaacaggggc

SEQ ID NO: 25 - DNA, 282 bp, Arabidopsis thaliana
  unsure (1) ... (282): unsure at all n locations
gatacatttggattcgaaaagagcagcctagaggatagacaaagagctgagaagaaaagcagagaagagaaaggccaaaantttccnccaaaatggtttnatgaaacanaagangtcactcctacaccatggggtgatctcgaagtttaccaattcantggaaagtactcggtgcaccgngccacagctgaaaactntgaggatacaaccgntgtgaagttgncccaattcaacccttggcaattccaagatctctntgcttaatcctttggtgccatttgt

SEQ ID NO: 26 - DNA, 380 bp, Arabidopsis thaliana
  unsure (1) ... (380): unsure at all n locations
cgttggtggcngcggaagtggtttcttcgcctctcttgcttcgtcgatctccaatttnggntctgctatgaccaaatcagttaatggtttggttccctatgagggacttgaagttatcaatcctgaaggaagtacagatgatgctgaggaggaagcaagcagaggaagatggaagcaagaggatcgagatggctattggaagatgatgcagaagtacataggatctgatgttacatcaatggtgacccttcctgtgattatttttgaaccaatgacaatgcttcagaaaatggcggagttgatggaatactcgcatctgctagacatggcagacaaaaccgaggacccttatttncgcatggtgtatgcatcatcgtggg

SEQ ID NO: 27 - DNA, 359 bp, Arabidopsis thaliana
  unsure (1) ... (359): unsure at all n locations
ggtaatgaaggagttgaggtcataaatccagaaggtggcaaggaagatnctgaagaggaagctcagaaaggaaggtggaaggacgaggaacgagatagttactggaagatgatgcagaaatatataggttcggatattacgtcaatggtggctcttcctgttgtnatatttnancctatgactatnctccanaagatggctgagataatggagtattctcatttnttggatcaagcagatgaatgcngagatccatacttgctgttagtatatccttcatcatggggtatatctgtttactatggccttccaacggaccttggaagcctttnaatccnattcttgggggggnnanttna

SEQ ID NO: 28 - DNA, 510 bp, Arabidopsis thaliana
  unsure (1) ... (510): unsure at all n locations
aaaagagaaaagtgttagcctttggtcaatgatcaaagacantatagggaaggntctcacaaaagtctgtcttcctgtttacttcaacgagccactttcttctttacagaaatgttttgaggatttggaatattcgtaccttcttgaccgagcatttgaatatggcaaaaggggaaatagcctcatgaggatacttaatgtagctgcttttgctgtatctgggtatgcatcaactgaaggaagaatttgcaaaccttttaatccattgttaggtgaaacatacgnggcagactatccagacaaaggccttcggtttttttccaggaaaggtcagtcatcatcctatggttgtcgnatgccattgtgatggcaccnggtgggaattcttgggggacagcaatcttnggggcaaattttggggcgntctntttagcttnacccccttggggattnnccttnaaattnatgatggggaanccncaggggggaaggngcccaccatnncaaacc

SEQ ID NO: 29 - DNA, 493 bp, Arabidopsis thaliana
  unsure (1) ... (493): unsure at all n locations
ccccncccngaaagnttcccctgtttccggnttnncccntntgnncccccttgggggggncctttcccaatnggnnttgggngngcccccttgganggggccggggctttaaagggccccncgnagggaaggccagcctttctcccaaatggtcgatgtaccggaggaagtcactgctaccccatggggtgatctggaagtttcccaattcaatggaaagtactcggaacatcgtgcagctgcggataactctgaagataacaccgaccctaagtcgatccaattcaacccatggcaattccaagatctgtctacttaaatgtatcgctccaaaagacagaaaagatcaaatctttttggaaacaaatgtattcttattctctcgtagttacaaaaaactttgttctacatctgctagctttcccattgctttctctagtattagtgtacaacttctactgttttgtcttaaattcattcaaatctttctttg

SEQ ID NO: 30 - DNA, 1305 bp, Saccharomyces cerevisiae
atgtctcaacacgcaagctcatcttcttggacttcttttttgaaatcgataagttcgttcaacggagatctatcgtctttgtctgcaccaccgtttattctttctcccacttccttaacagagttttctcagtattgggctgaacatccagctttatttctggagccttcgttgattgatggtgaaaactacaaagatcactgtccctttgacccaaatgtggaatcaaaggaagtggcgcagatgttggcggttgttaggtggtttatttctactttgagatctcaatactgctctagaagcgaatcgatgggttctgaaaagaagcctttgaacccattcttgggtgaggtatttgttggaaagtggaaaaatgatgagcatccagagtttggtgaaacggttcttttaagtgagcaagtttcacatcatccacctatgacagcattttcgatttttaatgaaaaaaatgatgtttctgttcaaggatacaatcaaattaaaactggttttaccaaaacattgacgctaacggtcaaaccatacgggcatgtcattttgaagattaaagatgagacctacctgattacaaccccgcctttgcatatcgaaggtattttagtcgcttctccatttgttgaattaggaggcaggtcattcatacagtcatcaaatggtatgttatgtgttatagaattttcaggaagggggtatttcacagggaagaagaactcctttaaggcaagaatttacagaagcccacaagagcatagtcataaagaaaatgcgctatacctaatctctggccaatggtcaggtgtttcaacaattataaaaaaagactcgcaagtttcacatcagttttacgattcatcggaaactcctactgaacatttattagttaagccaatcgaagaacaacatcctctggaaagtaggagggcatggaaggatgtggcagaagcaatcagacaaggaaatattagtatgataaaaaagactaaggaagaactagaaaataagcaaagagccttgagagaacaagaacgcgtaaaaggtgtggaatggcaaagaagatggttcaaacaagtggactacatgaatgaaaatacatcaaatgatgtagagaaagcaagtgaagatgatgcctttaggaaattggcgtccaaactgcagctttctgtgaaaaatgtgccaagtgggacattgattggcggcaaagatgataagaaagatgtttcaaccgcattgcattggaggtttgataaaaatttgtggatgagggagaacgaaattactatataa

SEQ ID NO: 31 - DNA, 1200 bp, Saccharomyces cerevisiae
atgacagtctcacacaatcattctacgaagatatcccaacaaccaatctcctcggtatcagcatttaagttcttcggaaagaagctgttaagttcaagccatgggaacaagttgaagaaaaaggcgtctctacctccagacttccactctacaagtactaatgacagcgaatcctccagcccaaaactgccgaattcgttgaaaacctctcgccgtgcaaactctttcgctcacacaaccaacagcaagagatctttatcttccgcctcaaccaagatcctacctccggccggctccagcacgtccatctcaagaggaaacagacattcgtccacttcgcgtaatctctcaaactccaagttcagtagcgaacgattagtgtacaatccatacggcgtctcaaccccaagcacgtcactctcgtccgtctctacctccatgaagaaagaccctgatctgggcttctaccttcacgatggggattccaaaatccgcatgctgccgatcccaattgtggacccaaacgagtatctgcccgacgagatgaaggaggcaagcatccagttgagcgataacttcgtctttgatgatgagaataagaccatcggatggggcggttcgtgcgaagtgcgcaagatccgctccaagtaccgcaagaaggacgtatttgctctaaagaagctcaatatgatctataatgaaacgcccgagaaattctacaacgctgctccaaaggagtttatcatcgcaaagcagctaagtcatcatgttcacatcacaaatactttccttctagtcaaggtgcccaccaccgtctacaccactcgcgggtgggggttcgtcatggagctaggtctacgagatttgttcgcgatgatacaaaaatcgggctggcgccacgtggccctagcagaaaagttttgtatattcaaacaggtggcgtgtggtgtcaagttttgccacgatcagggcatcgcccaccgtgatttgaaaccggaaaatgtactgctatccccggacggcgtgtgcaagctgacagattttggtatctcagactggtaccaccacggatccacacgacctgtccagccctgtcaagaagtgcgcagggatgatcggctcgccgccgtatgctcccccggaggtcatgttctacgactccaagaagcactacgatacggaattgcaacagccgtatga

SEQ ID NO: 32 - DNA, 309 bp, Saccharomyces cerevisiae
atggatcatccacataagtggcaccgtaagctcgtcaattgcaacagcgactttatttttaagagccgcggtcattttgttagtatctcttctcaacttgggcagcacaatttcacgatatttaacaggtatcatttgaaaaaaagaatcgttttccagatactcgtcaattcctcgcttcggttctctgaacaaaacttctcgattacgcaaaatgaggctggcatatggaagcagttgttcaactctccccaaagttttccacatactgatataccatcagaagaaggtaccaaagttattctataa

SEQ ID NO: 33 - DNA, 4014 bp, Saccharomyces cerevisiae
atggagcacagatataacgtgtttaatgatactccacgagggaaccattggatgggcagttctgtgtcaggatcaccacgtccatcttatagcagtcgtcctaatgtaaacacaacacgacgcttccaatatagtgacgatgagcccgctgagaaaatccgacctttacgctcgaggagctttaaaagtactgaaagtaacataagcgatgaaaaatcaaggatatctgaacgtgacagcaaagaccgctacattaatggtgataaaaaggtagacatttattcactgcctctaatatcaaccgatgttttagaaatttccaaacaaaggacatttgcggtgatattgtttttaataattcaatgttataaaatatatgacctggtaatacttaaatcggggttaccgctttcgggtttactgtttaagaactatcgatttaatttcatatccaagtatttcattatagattccttcttcctgtatgttttaccatcctttaacattcctaggttgacttttaagccatgggttgtttatctccagattttagctatgctactattgaacattttcatatcaagcgatcacgagttcgttttgatttcattaattatgaccacatggagaaaactttatacgaaagaattaagtgtaacaggttcagccattaaccatcatcgtatttttgattcttccgctcattttaagggtgctctaacaatcaagatcctacctgaaaacacagctatgtttaatcctcttcatgaatcatattgtttgcccatggataccaatctttttaaaattaactcaattgacgtacccatcagaataaactcaactgaagagattgaatatatcgagttggaatatagagatctttacacaaattcggtagagttacggtctttgagtaagaaagacttcaaaatcatcgataaccccaaatcctttttaaaaaaagatcagtcagttctaaagtcacattcaaacgattttgaagaaggcagtacaattcgttatttggctgtaactcttcaagatattggcttttatcaaatcaaaaaaattgttgattcaaaaaaactgaatttaaagatccatcagtcacacttggttgtaccctactgtccaattgcatctattactggaactggaagcaatgatagatgtattggcgattcagataatgtttcttttgaaattcaaggtgtgcccccaatgaaattagcatactctaagatcgttaatggtcaaactttttcatatgtagactccagcttgcaaccagaatattttgagtctcctttgcagtcaagcaaatccaaacaaagttttactcaaggagaactaaacgatttgaaatggggaagaaaccaacctgttaatattaatttagactcttccattacccaggacggcaaatttgcatataaaattgataaaataactgatggtctgggaaatgtcgtggattttacatctctccctgaagaattaaaaaagcgctatgatctatcttataatttcaatgttcatgaggttccacgtgcagcgctagaagaaagatttgatccaaagtcacccacaaaaaggtctattgccatcgtgtttgaagaaatcaaaaactggatttcagacattccatatgttattagcctatcctatactgatgcacaagacaagtcgaaaaagataatgaatgttactacagattctttgaccaaagtgttgcaagcggatcttccggggtcatataacttagaatatattgaatctaagttttgtccaggtgaaattgtgggtaaatcaaacgttcttgtaactatgccagttgcacctactatggaagttaaatcatttccaatattggaccagtgtgtgggacaggttggtctaaactttgaactatcttttactggggctccaccatactattataacactaaaatctataagcttgaaaacggtgaaagaaagttatatgatgcaaagagatacacctctgaaggtacgagaaatcgcttcagctatagtccacctaaagaaggtaactatgaaatcgtgtttgatactgtttctaataaattattcactgaaccaatcaaattggaacctgtaaaagaatatactttcaagacatcaatgagggtgaaaccaagcgcatcactaaaattacaccatgatttgaaactctgtttgggtgaccacagcagtgtcccagtagcactaaaaggccaaggcccttttacgttaacatatgatatcattgaaactttttctagcaagaggaaaacttttgaaattaaagaaataaaaaccaacgaatatgtcattaaaacaccagtctttactactggtggtgattatattctatctttggtttctatcaaggattctaccggctgtgtagttggactcagccaaccagatgctaaaatacaggtgaggagagatattccatctgctgcattcaatttttttgaacctatcaaagaagctaaaattaagcacggttctgtcactgaaattccgctcaaattaagtggagaggggccattcaccgttaagtttaaacacatggattacgatggaaacattgtgaaagaatttgaaaacaaatttcagaatagttataagcccgctttgaaagtaagtaaagaagggctttaccaattggtcgatattcgtgactcaagttgccaaggtaatgtgatttaccggaacagtctgtataaggtatctttcttggagaagccaaaatttgcaattcaagacaatcatcacattacaaaagtaacggaaaatttattctctaaagaagaagtctgtcaagggatggaaggtacggttgatttggctctatttggttctccaccattcatattagaatatgatttgatggcacccaacggtcatatttctacaaaaaaaattcaggtggcaaccaaatacgcttcactgaaactgcctaatcaaattcctggagagtacataactactattaaggccatcttcgatggcaattatggtgaaagcgacatacattttagagaacatcagtcggagctcataatcaaacagacagtgcaccccattccagacgtcgcctttgctgatggtggtaaaaccttgcgtgcatgtgctgctaatgtagatcaaatctcatttttggaaccaataaatttgaaatttttacaaggcgaaagcccattttcaatcacctttagcgtttatcacgagagtaccagtaggacagatcagtataccattgacaacattgactcagagaacttttcatttgaaaagttatatgaagggatgaagttaggtaaccatgccattactattgattctgttgttgacgcaaatggttgtgttaacagcctcatatctggaccgcgtaatcaaattcttgtgtcaattactgatgcaccaaagatacatatattagatccttctaccgagtattgtgttggggactatgttgcatatcaattaaacggtgtggcacctttcatgattaagtatgaattcaacggtattccactaaaatctaaggaacgcagctcccaatttgttagattagcatctgaaccgggcattatatctatcacttctttacaggattcatcatcacaatgcattgtcgactttacgaaccctaaattaaagagtgaatttgatgacttatctttaaacatacatcctattccttccgtaactgtttctcaaggaaattacgttactgaggatatccgcgaaggtgaccaggctgaagtaatcttttcgtttgaaggtaccccaccattctcactaacttatgtaaggacagaagagactgatggaaaacacggcaaaaggaggtcgcaggttgttgagacgcataaagtcactgatatatattctcatgaatacaaggtaattacaagcttgcaaggtacctacgaggcgattgaaattacagatgcttattgttttgccaaaaatgatctttttttcaataactaa

SEQ ID NO: 34 - DNA, 2394 bp, Saccharomyces cerevisiae
atggtacagaacaatgaatcggtttttttcgttgaatgcgactcttataaggagagcccttccacttcaccaatacgcttggacgacctggatggaaatgacgctgtgtcggatcagggtttagctttcgacggggacgtaggaattacatcacaagctcgagtaagaaatcctcgagctcaaatcttcgaggatagtaatactgacgtagtattgcatttggatgatcttgatatggtcccactaaatacgaagttcgatatgcagatggagatgggttcacccatggcgatgccggcagaaacgccacctcctgtcgaacctttaaaaacaaaagatctagcatattcatccttggctcaccttcctagctatttctttgagcaaacacatttccgcatagaccgcaaatgcctgttggaaatgtctaagttaaggcgaaattatctaactataagtaaacaagatgctttgtcatgtccgcagcttcattcaagagtggctgggggttatcttaaacctgtaaaagaaaaattatttggaatacgtcactttcttgatctagaggaaagtaatactgtaaacctcctccaggatggtaattatatgacggaattgttcaacagtcagattaatatccccacttttaaagaatttagggaagattttgaatggtgcttgaaaattataagagatagaagcctatcaaggtttagcgaaaaaagattacaatatcttgtaaataagtttccagtttttcaacacctacattccaaggaagaaatgagacagagcaaaaaggtgccacacaaggatttttacaactgtagaaagattgatctgaatcttctgttaagcggctgtttctcacagtggcaattgactgagtttatttggaccaagttgagaaaagaaccggacagggttatccatcaagcttttaatggtagtcatataaccttgagccaattattcaaagtgaatttcgaggagaccggtcagttcttcaatgggttgaaaattattgacgattcatttttggagtggtataaagttatttatctcgcaaaatatcatttggttaacgatgaaatggaaatacacacaggctcacacggtaagcagcttcgatactatttgattgcgaaaacatttttggagtttgataactatattaatggtgaatacttagcggaactactgaaaacgtttttaataaaaccgcaagaggagtcgaaatatcagttatgtcaactctccgtggacttccaattttatctgcattacgataattccgatgtggacaattggtggatggtctttgccaattggctgaaccactataatatattttctaacaatattcgctggaatattcgcatttctagaatttatccagaactgtatcatactggcaaggtgaagaattttcaggagtatttaaatctaatcttcaaaccacttttcaatgccgaaaattatctacacaagtcattaggacctattcttttgaaatttctttctcaagtatcttcgattgatctatgtattcaagatacggacaactatatttggaaaaacttcacagcagttagttgcttgccaaaagattggacatctggcggtgataatccaaccatttcacaatatatgtattacgtctacgtcaacctaacaaaattgaaccatatccgccaagcccttcatcaaaataccttcactttgagaagttcatgttctcccacctcaatgaatcgaacttcacagtttagtaatacactgaacttcacagaacatacggaagctattttaaacaatttcttgctcgcctgtggagggtttctaaatgcagaaaatctctggaatgcaccaccatcactggtgtatcttttctatctaagtcaaattcccatggttgtggcgcctttgaattccatagtagattcaaagcctacaatgctgcaagaacaagccccgacggggcttgtcctagagccctcaaagccttataagaagaaccctttcatgaagttttttgaaatggggttcaagatatcgctgagctcagaatctatcctctacaacaattcgtatacgaaagaacccattatagaagagtatagtgtagcggctagtatataccgtttacattcagcagatttatgcgaacttctaagaaacagtgtcataaccagtggattttcaagtaccctaaagaacaaatggctcggcgtttccttagccagccatgactacttcgtggaaaacactgggtttgtagacaagtggtatgattgtaaaccaaatacaagtttagagcataacgttccgatcatcagacgtcaatatcgcagtagcactctcgcaggggagtggcgactcataattgcgtga

SEQ ID NO: 35 - DNA, 303 bp, Saccharomyces cerevisiae
atgccaattgttcggtggctattattgaaaagcgcagttagaggttcttctctaataggcaaagctcacccttgtttaaggtctattgctgcacaccctaggtatttatctaatgtgtactcaccaccagcaggcgtcagtagatcactgcgcatcaatgtaatgtggaagcagagtaaattaactcccccaagatttgtgaagatcatgaatagacgccctctgttcacagaaactagtcacgcctgtgcgaagtgccaaaaaacgtcacaattactaaagtatgtttacacaaaagcttaa

SEQ ID NO: 36 - DNA, 888 bp, Saccharomyces cerevisiae
atgagtttgagaacgccgaagagaagcaggactagcgatgaacaagaacaagaacaagaacaagagcaggtacagaacccagatacacatgtaaacaacgagcatcagcagcgacctgggccaaccactctattgagcacgccagtacgtctcaaaaatggctttggaacaccatcgccgccgtcaccaccaggcataacgaaaagcatcactaaatcgagaagaaggccgtcgacaacgagtcttcagggtatattcatgtcgcccgtcaataagcgtcgtgtcggcataaccgcacatggacgtgtatatgaccataacgacgacggacacgaaagtgagagtgaggacgacgaaaatgaagaagaaaatgaaaatcaaaagaagtacgacggacacgttagtatgcctttgttgccaccgacaacgcccaagtcaagacggtcggaggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgagctggagacggagcttgctccagcagtgcagacgccgccacgtcgctatcacaacagatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaa

SEQ ID NO: 37 - DNA, 2121 bp, Saccharomyces cerevisiae
atggacaagctaactccatctcaatggaaggtaataaataagtcatatgaaccagcgtctacgataaaagtcattgcgggcccaggctcaggaaaaacgctaacgctactatataaagtactacatttaattactgtggagaatattaagcctgaagaaatacttatattttcgttaacaaacaaagcagttgatagtataatagaaaatttactgtccattttcgaaaactcgcatacaaataaggaaattgtccatcagattgggtgttacacagttcatgggttggctaatagaatcgttgtagagaatgaggggatgataaacattatagaagagattggatggagaggattaatgaagttgttaccgccgtcaaagagaaccccccatcatttcagatcatataaggaactcgagaaagttgttaaggattacaagctaaacaacgcaaaaaataataaccccgtcattgagaaactagttgaactgatggataactgtaaagtgatgaccaatgatgatttgatcattcgcgcaaaaaaatacttagagcttgattcttctgattcagatgcatcgtcttttactcaagatctccgcaataaatacaaggttgttcttatcgatgaatttcaggacctctatccaagtttagcacccttaattaccatgatttgcaaaggcaagcagctcattatgtttggtgatacaaatcaaagcatatacggatttttggggagtaacaacgagattatgtcacaattagacaatcttcacccaaaaaattccacgactgtcctgaaattatttgataattttaggtctacccccgaaataatctctctagcatcaaaaattatcaatcgtccactagcagagaaacagattatcgatgatactgatgaaacaccatcagagctagttcgcaagctaccgagtggtgtttcacctcaaataatgacatttgatgatctagccgcagaatctgaatttattattgataaaattacccaattgatttgttcttctgcaaagttttccgatatagcaattctatcaagaacaaattcacatctaacggctatagccagtattttgaagaaatatggtattccttatcaaaaactaaagagtcaacctgattggatggacgatttacgaattcaattccttttagatattctaaaagtgtgttctttagcctccgacgaaaagcataatcgtgagttcaatacgggtgataaatggcaaagtaacttcagcattttggtcacaatgagcgctctcaaagggattggcgatgcttcaatacaagccttgtataaagcatgcagcctgaaaaatctgtcaatttggaaatacctaactatggttcccaattttgaatggccattgggcctctccataaagaaaaaaatggaaaattacacttcaaatttatatgaaatgatcgaaaatgatcaagttcatcaattagatgatccgatggaacttttagaaaaagttgctagcatcacaaataacttaaacctaaatcctacctacttccaatccttaagtgatgctcaatcatctttagagtttaaaacacatctacaagagatggcacaagtaatgaaggtctcaaaatctaataagcccccgggtatttcatttgttaaatggtttctagagacatattttgatcaaacgatggtctttcaccagtctcagcaggcattacaaactaccggtccggggacagtaaaactatctaccatccattctgcaaagggtttagaatttcccatagtatttctaacaaacgggagcatgtccaatttcccaatggatacaaacgccctttatgtggggataactagggcaagaaacttgttgtacatgtgcaacatgaagcacgagagactggtcagtaaatcatcaccatactcaagaaacataatgtctaataatttattctggacttactacaataaggatttgaaacgatctgtatgtgacgttaaggtgacacatggttataatgtgcagcgatacaatcagttacgtaaaaattttggattttatagagcatattcttcactaagaggttgtaagagcgttttcagacgtatatag

SEQ ID NO: 38 - DNA, 3414 bp, Saccharomyces cerevisiae
atgaacgatatggcaaaacctctcccaactccaccgactgctgagatcaggaaaagtcgatccaattcaccaaaaaaagctcagaaaacaaatctaagtccaaacaaaaatcagaataatgagaaaaatgtacctagatcaaacggaagaaccaaaaacgaacacaatagtatggatgacgaagagtttgaattcttccatcaatttagtcgggagaaagttaaaggcgtcatacacgtaatcaccgctgaacttaaggaaaaaggtccagatgttgaatttttaatgataccgttcaggccggaacagacgaacgacaaattgctgacattactaaatcagctattcccactaggaaacggtcaaccagtcaacgaaaaaaaacagctcagaattgtttccaaggccgatgtctggactttatttcaatgcttaaaatacatttggtgcagacttccaaattcagaaatcataggctggaaatcttatttggagtttaaattcagggaagaagataaaaaatttcctcgaaaatcatttttggaaattatgcctcaatgtctagcttccccaaatcatgcatcaatcgtttacgatttttttgacttgattatttcaatttcatcaaattcaagagttaataaaatgagtgctagaaaaatatcgaagatgtgtgcaatctgggcgtttagtaaacagataccaaattctgatatccaagattacgattttgaatcagccgccatgaagtcttttgcccccaacaattccatacaagatgggctagatcagtggattccggcttcagatgccatgtttcacctactcttagcatttctaagaagttttgtccctcaagatcttgaatcggcaaagctgccgcgcacacttaagagtttactattcaataatcagtatcctccaagaaaatcaacagcgtacacatcagagacaatcctaaccattcctctggtaactttaaaaacagacgtcttttcgagaaaaccttggcaattattggagcgttgcaatgatcttcttgatttcagtgatcatgatgcattcgaagcaagagaggactacgctttattaaagtctttattcagaaagaaaaatacagtggagggaattagcaggaaaatgtcccaggagtcaagaaggttgatgaaagcaatgtctaccaaacattcaacatttcaaccaggttgggctcccagagaatgtattgaaaatatttctcatttaaaagaatgtattgaggttaaaagactagatatcgatgattattttatttggacttggttatcgtccctttctttcgaacaaacatccgaaaagaaaaaaatttttggaagatctattatattggaatttgaatttgatggatttaaaaaatgggtggttttccaagaatgtgatataacgttagattataataaaaagggtcaattgaagaaaaagacttctgcacagtcaccaacgaccgaaaaggaactacctcctgatgactttgaattagaagatccacctctctccaaatctcctacactatctcagacctacaaaaaattccaagctgaggtacctcagcaaagtactgttcgaagggattcagcacccgataaccaaggaatctatcacacagtcattagtaaaaatgcattgactaaaaataagcataatgtgaatttgcattcttttgaacataaaatctccaaatggaatcctctaaacaacctgcgaaagaaaagcggtagtaactctagtagttcatcatttgaggaaaaaagtaaagacgctcccatccgcgaagaataccataccaacaaaaatcacaaatcgaaaaaagaagagcgagtactatctcagtttagcacacttaatcctgatgaatatcagttaccagtaatagagaccggttcatcaaactttaagattgaaataccggaattaatgtacgaacacgatgatgacgacagtgacaaacttaaaaattcccagaaaagagctaccgactcagctattgaagaattaaacggtatggttgaagaaatgatgattaatgagccagacgatgtaaaaatctccataactgaggcagagactttcgaatcattgacaaagtttgatcaatataagccatccaatataactgacgatgacttacaaagcagccattcaagcgccgttcactcattgaagctaagtacaaatacaaatgattcttgcgctgatagttccaaatacaccgctgataggaaattagcggaacctagaaagatttctgaggaatccaaagtcaacgacgattcatcatcatattattctccaaatatcaacaacttgccggcatcaagaatgcctagtcaacccacttattcaaattcggattcgaaaaaggcatttacgaatgagtctcgcctgaacgtcttacaaggtgcagtcagtccatctcaacaggtaacaccaaaaccatataaaaatgcgcctggagactgtgtatctcctgttcagcaaaaatactatcagaacgatcgtagaaatgaaatgtcgcctgcaagtgcaccagttccaccttctgcatattcacctgcgaggtctccacaattctccaccaattcggctggattcaagcagaacacgattaatgtacccgttgggtataatgatcctgctcacgttttagcaaatcaaccacatatgacatatcgggaccagcataattatccatctcaccaacaaaaacaacgtcccttccaaaacaatattgtgcccccagaactaaagtccagaaatcaacgggcagatgcttcacctattccccaacatatggtgccagtaaaacaaggtgtgcccaatcttccatctaacgttccattatatcaacaaatggaacgaatgaaccctaaccaccagcaccctgtaaatacttacaaggtaactcagccgccgtatcataataacacaacaaatgcttatgggaacagccgggcaggcaatgctcatatgttagatggaaagtggagcaataatccgccgcaaatggtaccaaagggagttcgccccaatcaatatccacagcagcacgttaataggtattcaccgcaagctcaacctgtcgtacctgcggaatactacaatggacctccacctatgcgagcacctccaatgatgtcccatatggtaccagctcaggagccgatacgttacacagctggtgctaacaggcgtagttttccccaaggcatgcagcagaatgcctattccgtacccgctcagcctatgggggctgtaaatagtgaattttacctaccagaagctcctcagggaaacaaactgcatggaaatattaacaaaagacaggagagaaagaagctatatgataacattagaagcggaaatttcggcatatag

SEQ ID NO: 39 - DNA, 336 bp, Saccharomyces cerevisiae
atgtccctacggccttgtctaacaccatccagcatgcaatacagtgacatatatatataccctaacactaccctaaccctaccctatttcaacccttccaacctgtctctcaacttaccctcacattaccctacctctccacttgttaccctgtcccattcaaccataccactcccaaccaccatccatccctctacttactaccaccaatcaaccgtccaccataaccgttaccctccaattagccatattcaacttcactaccacttaccctgccattactctaccatccaccatctgctactcaccatactgttgttctaccctccatattga

SEQ ID NO: 40 - DNA, 882 bp, Saccharomyces cerevisiae
atggcgtcccaggttaacgccttattactgccggtcatagagtctacgccgcttcatcaaataaccaaggtagcattgacgaccacactcacaagtaaacaaagcgattacaagttcaaagaaatagccgtgccgttaacaaaatcactacaactgtacgagaaggcgcaaagaagacaagatttaagggcaagcttaaaagcactggagagtatcatttaccaaacgcacttccaatggaataacccgctcccacgacatgcgcatctcttccaaaaacactaccactttctactgactcactggccatttgagaaccacagagacttggtagattccatcgctgtaaacaatgggaaactaaattcaacgtcttcaaggagcgtctggctgaaggcggattggataacactgtttaacgttaaaaacccttgggtccaaacgccgccatcgttaatgcgtctgagtgggacagatcttgataccttcacaccagagaggatattcctgataaattctcttggaaaccactacaaatttttaatagcgaacagtcatctaagctacaatcacaaaaaatacccctcccctggcgtgcaaattcctgtcaggaacgctcttggcgaagtttctccggccaaacaaattgcccaacttttcgcaagacagctgtctcatatttacaagagcctcttcatagaaaaccccccgctctctcctgagaacgagctggcattgactgccgtcttctatgacgagactgtagagcgacgccttagaaggctctatatgcgagcttgtgcaagggcatatacgactactaatgccgactccaccacggagcctttgatgtttcattgcacccggtgggaagttgattag

SEQ ID NO: 41 - DNA, 3552 bp, Saccharomyces cerevisiae
atgaaaatactcctatcgaaacagcaaactagaaagatagcaatagtttcagaaacacatggactggtatttaggccaataaacagtaagaactctcgcagatctacatgtgccgtggaattggttccgaaagctgaattaaatggtaatggtttcagaagactatctaaccatgaaatatacggttttattggtctcatagaaattgaaggccttatgttcatagcaaccataacaggtaaatctaaggtggcccagccgatcccaaacaaaacggttaacaaaatatatgctgtggattttttttgcttaaataattctaaatgggatttcatggacatcgattcatccggttatccgattgttactaatgatggagattttgcaataagctcgcctcctagtatttccacacattcttctagatcatcgctacgttcttcttcctctaggagtttgaatgctcaagaacaagctcccaagcatccatgtcatgaactaagaaagctattatcaaatggatctttttattacagcaccgattttgatttaacttgtacattgcagaaacgtggattcacggaacactctttgagttttgatgattttgaccgggagtttatgtggaactcgtttcttatggacgaaatcatcacatacagagacagactagatgtaacggccaaagaactattggatcaacgaggattcctcacgaccgtaatccgagggtttgctgaaacaatttttagctatattaataggttgaaagtaggacttaccattatttccaggcaaagttggaaaagagcaggcacaaggtttaatgcacgtggtatagatgatgatggccatgtcgcaaattttgttgaaacagaaatgattatgtactcttctcagtattgttatgctttcacgcagataagaggaagccttccaattttttgggagcaggatacatctttgattagtccaaagattcaaattaccagatctgttgaagcaacacagcccacgtttgatgaacattttataagactatttaagaagtatgggccagttcatataatcaacctgctgtctactaaatcttcagaaattcaattatcgaggcgatacaaggaacagttgaaaaattctgagaaaatgaaaatcggtagagatgtgttcctaacaagctttgatttccatagagaaacttcgcaagatgggtttgcagctgcaagtaggattatccctaaaataagaaacacaattttggacgccggttacttttcatacgatgtaaaagaagggcgattaatatccgaacaagacggtgtctttagaaccaattgcttggattgtttagatagaacaaatttgatccaacagacgatttcactggccgttttcaaactatttttggaagacttccgattggtaaaacccagtagtttcatcgacgataatgaatttgtgcaaaaggtgaatgctttatgggccgacaacggagatcagatatcacaaatttacactgggacaaatgctctgaaatcgtcctattcaaggaaaggtaaaatgtctttttctggcgccctttctgatgcgacgaagtccgttagtagaatgtacatcaacaattttgtagataaaggaaaacagcaaaatattgacacacttttgggcaaactaccgcaccagcaagttgttgaactttatgatccaatctgcgaatacgtcaatgaaaggctgttagagtcagaggaaaaattcaccactcattctaacataaatttgtttgtcggtacattcaatgttaacggaaactctcgaagagcagatttgtcaaaatggttatttccaatcggcgataaattcaaacctgatgtcgttgtgttagggttgcaggaagttatagagttgaccgcagggtctatcttgaatgcagattatacgaaaagttctttttgggaaactatggttactgactgtttgaatcaatacgaagaaaaatatcttttacttagagtggaacagatgtcctctcttttgatactattttttgcaagatcagatagagcctataacataaaagaggtaggtgggtctaccaaaaagactgggtttggtggtattactggaaacaaaggtgcagtagccattagattcgattatggggcaacttcattctgtttcgttaatacacatttatcagcaggtgcgagtaacattgacgaacgtcgcaatgactacaacaatatctacaggaacataacctttccaagatcaaagacaattccacaccatgattcgttgttttggttgggtgaccttaactacaggataactttgacaaatgatgaagttagaagagaattaagggctcaaaaggatggctatattgatagattgcttcaatatgatcagttgactcaagaaataaatgaaggagtggtatttcagggctttaaagaaccgaccctccaattccgtccgacctataaatatgattatggcacagataattatgatacttctgaaaaggcgagaactccgtcttggactgatagaatcatatataaaggtgaaaacctgcatccattggcatattcggacgcacctttaaaaataagcgatcataaaccagtttatgctgcatatagggcaaatgtgaaatttgttgacgaaaaagagaagcttaacctagttgagaagctgtatgcagaatataagaatacgcatcccgaagcactaactacaggtcctgacgaactttctcatgcaagaatggaaaaacaaaaggaaagtatacccttagatgcaaccgttcaatcagcgggcataaaactaattgacctagatgatacttcctcgtgcgtttcgcctctactttctggtcccagtccccaaccgtctgttgttggccctggaggactcagtaacgtatcacccgataaaagtaagctcaatgtgcttcctccgcctcctcctacctcgaggcacaataaggaaccatcttctaaacttctttcccctaccaaagagatttccattgtcagcgtatcgccgcgtaaaggtgagagcaatcttcctgccttagagagacacagtacacccaaaccactgccgccagtgcccgctttatctttatctaagccagtctctttacagaaaagttcttcagaattacagcatgctaaagagaccatagataatgggaaaattgttcctcgaccttgtcctcctattagaaggaagagcagtactgccccggacgaaatctctacatctaccaaaaattcaggtgtgtccactacagaagatcctgagccagcaaaggcctccacaaaacctgagaagccaccagttgtcaaaaaaccgcattatttaagtgttgctgctaacaagcttaacacctctcaagaacactcaataaaagtttccccgtcgaattcaaaatctgaagaggaactcccttgcaagaaaaagtctaaaccaaaagttcctgcgaagaaccctgaactagagaagctaagcgttcatccattgaagccttgcgaccccaattaa

SEQ ID NO: 42 - DNA, 2742 bp, Saccharomyces cerevisiae
atgagcgaagtcggtatacagaatcacaagaaagcggtgacaaaacccagaagaagagaaaaagtcatcgagctaattgaagtggacggcaaaaaggtgagtacgacttcaaccggtaaacgtaaattccataacaaatcaaagaatgggtgcgataactgtaaaagaagaagagttaagtgtgatgaagggaagccagcctgtaggaagtgcacaaatatgaagttggaatgtcagtatacaccaatccatttaaggaaaggtagaggagcaacagtagtgaagtatgtcacgagaaaggcagacggtagcgtggagtctgattcatcggtagatttacctcctacgatcaagaaggagcagacaccgttcaatgatatccaatcagcggtaaaagcttcaggctcatccaatgattcctttccatcaagcgcctctacaactaagagtgagagcgaggaaaagtcatcggcccctatagaggacaaaaacaatatgactcctctaagtatgggcctccagggtaccatcaataagaaagatatgatgaataactttttctctcaaaatggcactattggttttggttctcctgaaagattgaattcaggtatcgatggcttactattaccgccattgccttctggaaatatgggtgcgttccaacttcagcaacagcagcaagtgcagcagcaatctcaaccacagacccaagcgcagcaagcaagtggaactccaaacgagagatatggttcattcgatcttgcgggtagtcctgcattgcaatccacgggaatgagcttatcaaatagtctaagcgggatgttactatgtaacaggattccttccggccaaaactacactcaacaacaattacaatatcaattacaccagcagctgcaattgcaacagcatcagcaagttcagctgcagcagtatcaacaattacgtcaggaacaacaccaacaagttcagcaacaacaacaggaacaactccagcaataccaacaacattttttgcaacagcagcaacaagtactgcttcagcaagagcaacaacctaacgatgaggaaggtggcgttcaggaagaaaacagcaaaaaggtaaaggaagggcctttacaatcacaaacaagcgaaactactttaaacagcgatgctgctacattacaagctgatgcattatctcagttaagtaagatggggctaagcctaaagtcgttaagtacctttccaacagctggtattggtggtgtttcctatgactttcaggaactgttaggtattaagtttccaataaataacggcaattcaagagctactaaggccagcaacgcagaggaagctttggccaatatgcaagagcatcatgaacgtgcagctgcttctgtaaaggagaatgatggtcagctctctgatacgaagagtccagcgccatcgaataacgcccaagggggaagtgctagtattatggaacctcaggcggctgatgcggtttcgacaatggcgcctatatcaatgattgaaagaaacatgaacagaaacagcaacatttctccatcaacgccctctgcagtgttgaatgataggcaagagatgcaagattctataagttctctaggaaatctgacaaaagcagccttggagaacaacgaaccaacgataagtttacaaacatcacagacagagaatgaagacgatgcatcgcggcaagacatgacctcaaaaattaataacgaagctgaccgaagttctgtttctgctggtaccagtaacatcgctaagcttttagatctttctaccaaaggcaatctgaacctgatagacatgaaactgtttcatcattattgcacaaaggtctggcctacgattacagcggccaaagtttctgggcctgaaatatggagggactacataccggagttagcatttgactatccatttttaatgcacgctttgttggcattcagtgccacccatctttcgaggactgaaactggactggagcaatacgtttcatctcaccgcctagacgctctgagattattaagagaagctgttttagaaatatctgagaataacaccgatgcgctagttgccagcgccctgatactaatcatggactcgttagcaaatgctagtggtaacggcactgtaggaaaccaaagtttgaatagcatgtcaccaagcgcttggatctttcatgtcaaaggtgctgcaacaattttaaccgctgtgtggcctttgagtgaaagatctaaatttcataacattatatctgttgatcttagcgatttaggcgatgtcattaaccctgatgttggaacaattactgaattggtatgttttgatgaaagtattgccgatttgtatcctgtcggcttagattcgccatatttgataacactagcttatttagataaattgcaccgtgaaaaaaaccagggtgattttattctgcgggtatttacatttccagcattgctagacaagacattcctggcattactgatgacaggtgatttaggtgcaatgagaattatgagatcatattataaactacttcgaggatttgccacagaggtcaaggataaagtctggtttctcgaaggagtcacgcaggtgctgcctcaagatgttgacgaatacagtggaggtggtggtatgcatatgatgctagatttcctcggtggcggattaccatcgatgacaacaacaaatttctctgatttttcgttatga

SEQ ID NO: 43 - DNA, 7482 bp, Saccharomyces cerevisiae
atggctaaacaaagacaaactactaaatcgtctaagcgatatagatattcttccttcaaggctaggattgacgatttgaagattgaaccggctagaaatttggaaaaaagggtacatgattatgtcgagtcgtcgcattttctcgcttcctttgatcagtggaaagaaattaatttaagtgccaaatttacggagtttgcagcggaaattgagcatgatgttcaaacattaccccaaatactatatcatgataaaaagatttttaattctttggtttcattcattaactttcacgatgagttttctttgcaaccgcttctggacctcttggctcaattttgtcatgatttaggtccagattttcttaaattttatgaagaagctatcaaaactttaataaatctgttagacgctgctatagaatttgagtcatctaatgtttttgagtggggtttcaactgtttggcttatattttcaagtatctctcgaaatttttggttaaaaaactggtactcacatgtgatcttttaattccactattgtctcattctaaggaatatctttcaagattttcagcagaagcattatcttttttagtaagaaagtgtcctgtttctaacttgcgcgagtttgttagatcagtttttgaaaagttagagggagatgatgagcaaactaacctctacgaagggcttctgatattattcacagaatccatgacgtcaacgcaagaaactctgcattcgaaagctaaagctatcatgagcgttcttttgcatgaagctttgaccaaatcatccccggaaagatctgtttcattgctctcagatatttggatgaacattagtaagtacgcctcaatcgaaagtttacttccagtctatgaagttatgtatcaggattttaacgattctctcgatgccaccaatatcgatagaatattaaaagtattgacaacaattgtcttctcggaaagtggtagaaaaattcctgattggaataaaattactatcctaattgaaagaataatgagtcaaagtgaaaattgtgcttcgctttcacaggataaagtggctttcctatttgctttatttattcgtaacagtgacgtgaaaactttaacattattccaccaaaaactttttaactacgctttaacaaatatatctgactgtttccttgaattctttcaatttgctttaaggctaagctatgaaagagtattttcattcaatggattaaaattcctacagttatttttaaagaaaaattggcaatcacaaggaaaaaaaattgcacttttttttctagaagtagatgataagcctgaactgcagaaagtacgggaagtaaatttcccagaagaatttattttatctatcagagatttttttgtcacagcagaaattaatgattcgaatgaccttttcgaaatatattggcgagctataatttttaaatattcgaaattacagaatacagaaattattatcccattgcttgaacgtatcttttcaacttttgcatcaccagataattttacgaaagatatggtcggtacactcttaaaaatatatcgtaaagaagacgacgcttcagggaataatctattaaagactattctggataattacgaaaactataaagaaagtttaaactttttaagaggatggaacaagttagtgagtaatcttcatccttcagaaagcttaaaaggactaatgtcacactatccaagtctactccttagcttgacagataattttatgttgcctgatgggaagattcgttatgaaactttagaattaatgaagacattaatgattttgcagggtatgcaagtacctgacctcctttcttcatgtatggttatcgaggaaatacctcttacactacaaaatgccagagatttaaccattagaatcaagaatgttggtgccgaattcggaaaaaccaaaacagacaagctagtatcctctttctttctcaaatacttatttggccttcttaccgttagattctctccagtttggactggtgtttttgacactcttcctaatgtttacacaaaagatgaagccctcgtttggaaacttgtgctatcattcattaaacttcctgatgaaaatcaaaatttggattactaccagcctcttcttgaagatggtgcaaacaaagttctgtgggattcgagtgtagtgaggttaagggacactattgatacgttctcacatatttggtcaaagtattctactcaaaatacgagcattatatctactactattgaaagaagggggaacaccacctacccaattttaattagaaatcaggctctaaaagttatgctatcgattcctcaagttgctgaaaatcacttcgtcgacatcgcaccttttgtttataatgacttcaagacttacaaagatgaagaggatatggaaaatgaacgtgttattactggttcatggacagaagttgatagaaacgtgtttttaaagactttaagcaagttcaaaaatataaagaatgtttatagtgcaacagaattgcacgatcatctgatggtactgttgggtagccgtaatacagacgttcagaagcttgcgttggacgcacttcttgcatacaaaaatccaacgttgaataaatatagagataatttgaaaaatctactagatgacaccttattcaaggacgagattacgacttttttaaccgaaaatgggtcgcagtctatcaaggctgaggacgaaaaggtagtcatgccttatgtccttagaattttcttcggtcgagcacaagtccccccaactagtggacagaaaagaagccgcaaaatagctgtcatttcagttttgccaaattttaagaagccatatattaatgattttttgagtttggctagtgaaaggctggattataattatttttttgggaacagccatcaaataaatagctcaaaggctaccttgaaaactatcagacggatgactggtttcgttaacattgtaaattctactctgtctgtattaagaacaaattttcctttgcatactaattcagtgctgcagccgttgatctattcaattgctatggcatactatgtcttagatactgagagcacagaggaggtacatttaagaaagatggcaagtaatttaaggcaacaaggtctaaaatgtttaagtagtgtctttgaatttgttggaaatacatttgattggtctacttctatggaagatatttacgccgttgtagttaagcctcgtatttcacatttttcggatgaaaacttacaacaaccctcctctttactaagacttttcctttattgggcacacaatccatctctgtaccagtttttgtattacgatgaatttgcaactgccactgcattgatggacaccatatcaaaccaacacgttaaggaagctgttattggcccaataattgaagcggcggactcaattattagaaatccagtaaatgatgatcactacgtagatttggtgactctcatctgcacatcatgtctgaaaatacttccttcgctatatgtcaaactttctgactcaaactcgatttccacatttttgaatttgctagttagtatcactgagatgggatttattcaagatgatcatgttagaagtcgtttaattagttcattaatatcaatattaaaaggaaagctaaaaaaactgcaggaaaatgatacccaaaaaattttgaaaatattaaagctgatagttttcaactacaattgttcttggagtgatattgaagaactatacactaccatatcttctttgttcaaaacatttgacgagcgaaacctcagggtttccttgacagagctcttcatagaactcggtagaaaagttcctgaattagaaagtatttcgaaattggttgcggacttgaattcatactcctcatcacgtatgcatgaatatgattttcctagaattttatcaactttcaaggggttaattgaagatggttataagtcctacagtgagttagagtggttacctctgttgttcacctttttacattttatcaataataaggaagaacttgcgttaagaacaaacgcatcccacgctataatgaagtttattgacttcattaacgaaaagcctaatcttaatgaagcttcaaaatcgatttctatgctgaaggatatacttttacccaatataaggattggcctcagagactccctagaagaggtacaaagtgagtatgtatcagtgctatcatatatggtaaaaaacacgaaatatttcaccgacttcgaagatatggccattttactgtacaatggtgatgaagaagcagatttttttacaaacgttaatcatattcagcttcatcgtcgtcagagagccattaaaagactaggtgaacatgctcatcaactcaaagataacagtatatcccattatttaattccaatgatcgaacattatgtcttttcggatgatgaaagatacagaaatattggaaatgagacccaaatagccatcggagggttggcgcagcacatgagttggaatcaatacaaagctcttcttagaaggtacatttctatgttgaaaaccaagcctaaccaaatgaagcaagccgtacaattaattgttcaactttctgttccacttagagaaactcttcgtatcgtaagagatggggctgagtcgaaacttactttgagcaaatttccttccaacttagatgaacccagtaattttattaagcaagaattgtatccgactctttcgaaaattcttggcactagagatgacgaaactataattgaaagaatgcctattgcggaggcattagttaatattgttttagggctcacaaatgatgatattactaatttcctccctagtattctaacaaatatttgccaagttttgagaagtaaatccgaagaattaagagatgcagtaagagtaaccttgggtaaaatcagtattatcttgggcgctgagtatcttgtctttgtgataaaggaattaatggctacattaaaacgtggttctcaaattcatgtgttaagttacactgtccactacatattaaagagtatgcacggagtcttaaaacactccgatttggatacctcgtccagtatgattgttaagattataatggaaaatatctttgggttcgctggtgaagaaaaagactctgagaattatcatacaaaagtgaaagaaattaagagtaataaaagctatgatgctggtgaaattctcgcctcaaacatcagcctgacagaatttggaacattactctctcctgtgaaggctttgttgatggtcagaattaatctaagaaatcaaaacaaactgagtgaattattgagacgatatttgttgggtttaaatcataatagtgactctgagtcagaaagtatcctcaagttctgccatcagcttttccaggaatcagaaatgagtaattcccctcaaataccaaagaaaaaagtgaaagaccaagtagatgaaaaagaagactttttcttggtaaatttggagtcgaaatcttataccatcaactcaaacagtttgcttttgaacagcactttacaaaaatttgctttagacttacttaggaacgtaataacgagacaccgctcctttttaactgtctcgcacctagagggttttattccatttttgagagattcgttactttcggaaaatgaaggtgtggtaattagtactttacgtatcctgattacattaattaggctagatttttccgatgaatctagtgaaatcttcaaaaactgtgcgaggaaggtactaaatattatcaaggtttctccttcaacttcaagcgaattatgccaaatgggtttaaagtttctttctgcctttatacgtcacacagattcaacattaaaggatactgctttgagttatgttctagggagggtcttaccagatttaaatgaaccaagcagacaaggccttgcttttaatttcctaaaagcacttgtttcaaaacatatcatgcttccagaactctatgacattgcggatactactagggaaatcatggtcacaaaccactcaaaagaaattagggatgtatccaggagcgtttactaccaatttttaatggaatatgaccaaagtaagggtcgtttagaaaagcagttcaaatttatggtcgacaatttacagtatcctaccgagtccggccgtcagtccgtaatggaattgatcaatttgattattacaaaggctaatcctgctttactatccaaattatcatcttccttctttctggcgctagttaatgtttcttttaatgatgatgcgccaagatgccgtgagatggcttcagtattgatttccaccatgcttccaaagcttgaaaataaggaccttgaaattgttgaaaaatatatagccgcttggctaaaacaggttgataatgcatcctttttaaatcttgggttgagaacttataaggtctacttgaaaagtattgggtttgaacatactattgagctagacgagcttgccatcaagcgtataaggtacattttgagcgatacgtcggtaggatcagaacatcagtgggatttggtatactcagctttaaatacgttctcatcttatatggaagcaacagagagcgtttataaacatggtttcaaagacatatgggatggtattatcacatgtctcttgtatccgcactcatgggtccgtcaatcggcggcaaatcttgttcatcaactcatagccaataaggataagctggagatatcattaaccaatctggaaattcaaaccattgcaacaagaattcttcaccaattaggtgcgccttctattccggagaatcttgcgaacgtctcaataaaaacattagttaatatcagtatcctatggaaggagcaacgcacgccgttcataatggatgtatcaaaacaaactggagaggatctaaaatatactaccgccattgattatatggtaactcgaattggtggtattatcaggtcggatgaacatcgtatggattcttttatgtcgaagaaggcgtgtattcagttattggccttattagttcaagttctggacgaagacgaagtaattgcagaaggggaaaagatattattgccgctatatggttatttagaaacatattactcaagagcagttgatgaagaacaggaagaactacgcactctttcaaacgaatgtttaaaaatactggaagacaaattgcaagtatccgattttacaaaaatatacactgctgtcaaacagaccgtattagaaagcagaaaggaaaggagatctaaaagggcaattctggctgttaacgctccacaaatttctgctgataaaaagttgagaaagcatgcgagatcgagggaaaagagaaagcatgaaaaggatgaaaatgggtattatcaaagacgtaacaaaagaaagagagcctag

SEQ ID NO: 44 - DNA, 4104 bp, Saccharomyces cerevisiae
atgcaaagaccatttctactcgcttatttggtcctttcgcttctatttaactcggctttgggttttccaactgcactagttccaagaggatcctccgaaggaactagctgtaattctatcgttaatggctgtcccaacttagacttcaattggcacatggaccagcaaaatatcatgcagtatactttggatgtgacttccgtttcttgggttcaagacaacacataccaaatcactattcatgtcaaaggtaaagaaaatattgacctgaagtatctatggtctttgaaaatcattggtgtcactggtccaaaaggtaccgtccaactatacggttacaacgaaaatacctatttgattgacaacccaactgatttcacagccacttttgaagtttatgccacacaagatgtcaacagctgtcaggtgtggatgcctaacttccaaattcaattcgagtatttgcaaggtagtgccgctcaatatgcaagctcctggcaatggggaactacatcttttgatttgtctactggttgtaacaactatgacaatcaaggccactctcaaacggatttcccaggcttctattggaacatagattgtgacaataattgtggcggtacgaagtcatctaccactacatctagcacttccgagtcatctaccactacatctagcacttccgagtcatctaccactacatctagcacttccgagtcatctaccactacatctagcacttccgagtcatctacatcatcatcaaccaccgctcctgctacaccaaccactacctcatgcactaaggaaaagcctacacccccaaccactacctcatgcacaaaggaaaagcctacacctcctcatcacgacaccactccatgtacaaagaagaaaactaccacatctaagacatgcactaagaagactactactccagtaccaaccccatcaagctctactactgaaagttcttctgctccagtaccaactccatccagctctactactgaaagctcttctgctccagtaaccagctctaccactgaaagctcttctgctccagtaccaaccccatcaagctctactactgaaagctcttctgctccagtaaccagctctaccactgaaagctcttctgctccagtaaccagctctaccactgaaagctcttctgctccagtaccaactccatccagctctactactgaaagctcttctgctccagtaaccagctctaccactgaaagctcttctgctccagtaaccagctctaccactgaaagctcttctgctccagtaaccagctctaccactgaaagctcttctgctccagtaaccagctctaccactgaaagctcttctgctccagtaccaactccatccagctctactactgaaagctcttctgctccagtaaccagctctaccactgaaagctcttctgctccagtaccaactccatccagctctactactgaaagctcttctgctccagtaaccagctctaccactgaaagctcttctgctccagtaccaactccatccagctctactactgaaagctcttctgctccagctccaaccccatcaagctccaccactgaaagctcttctgctccagtaaccagctctaccactgaaagctcttctgctccagtaccaactccatccagctctactactgaaagctcttctactccagtaaccagctccaccactgaaagctcttctgctccagtgccaactccatcaagctctactactgaaagctcttctgctccagtaccaactccatcaagctctactactgaaagctcttctgctccagctccaaccccatcaagctctactactgaaagctcttctgctccagtaaccagctctaccactgaaagctcttctgctccagtaccaactccatccagctctactactgaaagctcttctgctccagtaccaaccccatccagctctactactgaaagctcttctgctccagtaccaactccatccagctctactactgaaagctcttctgctccagtaaccagctctaccactgaaagctcttctgctccagtaaccagctctaccactgaaagctcttctgctccagtaccaactccatccagctctactactgaaagctcttctgctccagtaccaactccatccagctctactactgaaagctcttctgctccagtaccaactccatccagctctactactgaaagctcttctgctccagtaaccagctctaccactgaaagctcttctgctccagtaccaactccatccagctctactactgaaagctcttctgctccagtgccaactccatccagctctactaccgaaagctcttctgctccagtaccaaccccatcaagctctactactgaaagctctgtagcaccagtaccaaccccatcttcctctagcaacatcacttcctccgctccatcttcaaccccattcagctctagcactgaaagctcttctgttccagtaccaaccccatcaagctctactactgaaagctcttctgctccagtatccagctccaccactgaaagctctgtagcaccagtaccaaccccatcttcctctagcaacatcacttcctccgctccatcttcaattccattcagctctactactgaaagcttttctactggcactactgtcactccatcatcatccaaataccctggcagtcaaacagaaacctctgtttcttctacaaccgaaactaccattgttccaactaaaactacgacttctgtcactacaccatcaacaaccactattaccactacggtttgctctacaggaacaaactctgccggtgaaactacctctggatgctctccaaagaccgttacaactactgttccaactacaactacgacttctgtcactacatcatcaacaaccactattactactacagtttgctctacaggaacaaactctgccggtgaaactacctctggatgctctccaaagaccattacaactactgttccatgttcaaccagtccaagcgaaaccgcctcggaatcaacaaccacttcacctaccacacctgtaactacagttgtctcaaccaccgtcgttactactgagtattctactagtacaaaaccaggtggtgaaattacaactacatttgtcaccaaaaacattccaaccacttacctaaccacaattgctccaactccatcagtcactacggttaccaatttcaccccaaccactattactactacggtttgctctacaggtacaaactctgccggtgaaactacctctggatgctctccaaagactgtcacaaccactgttccttgttcaactggtactggcgaatacactactgaagctaccacccttgttacaacagctgtcacaaccaccgttgttaccactgaatcctctacgggtactaactccgctggtaagacgacaactggttacacaacaaagtctgtaccaaccacctatgtaaccactttggctccaagtgcaccagtaactcctgccactaatgccgtaccaactacaataaccactactgaatgttctgctgctacaaacgctgccggtgaaactacatctgtatgctctgctaagactatcgtaagttctgcaagcgcaggcgaaaacactgcaccttcggctaccacccctgtcacgacggctattccaaccacagttattaccactgagtcatctgttggtactaactccgctggcgaaacaacaactggttacacaaccaagtccatcccaaccacttacataaccactttgattccaggttcaaatggtgccaagaattacgaaactgtggccacagcaaccaaccctatttcaatcaagactacatcccaactagctacaacagcttctgcttctagcgtggctcccgttgtcacatctccatctctaactggtccactacaatctgcttctggttctgcagtcgctacatactctgttccttctatctcgagtacttaccaaggtgctgctaatatcaaggttcttggaaactttatgtggttgctactcgctcttccagttgtattctaa

SEQ ID NO: 45 - DNA, 318 bp, Saccharomyces cerevisiae
atgacggggtacagggtcatacacctcacaggcatatattataccttctatcgccgaaaaagcttcttcttcttcttccttgaatatctccataatagtttgcgcgtactgtcctggaagggtataataaccaaaatagcagcttcaccgttcgtaattgttctttatttcaatactgcattttttaatccttttaagaccctttacgaaaatgaaaaaaaaaaagccaagaaaaacttgaaactgacgcgcgaaaacgcgtcactaagcataaggaaaatgcatcaatacagtgccattattccaagtgggacctga

SEQ ID NO: 46 - DNA, 309 bp, Saccharomyces cerevisiae
atggtgccactgatattgcttatcttacttttttctaaattttcaacatttctgcgccctgtaaatcacgtgctcgttacaaaatacactgccatagtaaatacaaaatggcaaacaacgcccagcatcattgatgttacatatactatgcacgttttttatatgacgataatacttattttggtcaggaagcaaatgcagtccatacatgcgtttctgggtagtttatgcttaccctcccacgtgctagatttttcgattgtaagagatattttatcatggtatttccttgagacagtcgcagtatga

SEQ ID NO: 47 - DNA, 1110 bp, Saccharomyces cerevisiae
atggatacagatttagatgtgcctatgcaagatgctgttaccgaacagctgactcccacagtatctgaagatatggatctcaacaacaattcatcggataataatgcagaagaattctcggttgatgatttaaaacctggttcctcgggcatagcagatcacaaatcttccaaaccactagaactgaataacacaaatataaatcagcttgaccaatggattgagcatttgagtaaatgcgagccactatcagaagacgatgtagcacgactatgtaaaatggcggtggacgtgttgcagttcgaggagaatgttaaaccaattaacgtgcctgttaccatttgtggtgacgtacacggtcaattccatgacttgttagaactttttaagattggtggcccttgtcctgacaccaattaccttttcatgggtgattacgtggatagaggatattattctgttgaaactgtatcttacctagttgccatgaaagtcagatacccacatagaattacgatactgagaggcaatcacgagtctaggcagattacccaagtatacgggttttatgatgaatgtttgagaaagtacggcagtgcaaacgtgtggaaaatgttcacagatcttttcgattattttcctataaccgcattagtagataataaaattttctgtctgcatggaggactttcccccatgatagaaaccatagatcaggtgagagagttgaacagaatacaggaagtgcctcatgaaggtcctatgtgtgaccttctatggtcagaccctgacgatagaggcggatggggaatcagtcccagaggtgcaggcttcacttttggacaagatgtcagtgagcaattcaatcacactaatgatctatcactaatagcaagagctcaccaattggtaatggaaggctatgcttggtctcaccagcaaaatgttgtcaccattttcagtgctcctaattactgctacagatgtggtaatcaagcagctatcatggaagtggacgagaatcataatagacaattcttacagtacgacccatccgtaagaccaggtgaacctagcgtcagcagaaagacgccagattactttttatga

SEQ ID NO: 48 - DNA, 1557 bp, Saccharomyces cerevisiae
atggaagacaaagatatcacatcggtaaatgagaaggaagtgaacgagaacactaatcctagaataataaaatatgatgccgagaggcgtgcaacccgtactgaaacctcaaagaaagataaatggaaaaacatagttacaatcattgcgtccggttttgctctgataagtgatggttacgtaaatggttcaatgagtatgctaaacaaggtttttgttatggagtacggtaagaaaaactatagctcaaaagtgtcgactagagtttccaacgcagccctagttggtattatttttggccaattctttatgggtatcgctgctgattattatagtagaaaatcttgtatccttgtggccactgctatcttggttattggtagtgctctgtgtgctgcctctcacggtactactgtacctggcatgttttggatgttaacagttatgagaggtttggtaggtattggtgttggtgcagaatatcctaccagtacattaagtgctaatgagtctgctaatgaatataccactaccaaaagaggtggtatcctggttatggtgacaaatttgccactagccttcggtggtccatttgctacgatcatctttttaatcgtctacaaaatctgttcaggaacaaaacatttagaggcgatctggaggactgtttttgcaatagggtgcttctggccattgagtgtgttctattttagatggaagactgctactacagaagtctatgaaaaaggtagaatcaagagaaatataccatatttcctagcattgaaattttattggaaaaggttacttggtacatgtggtacatggtttatgtatgattttgttaccttcccaaatggtattttcagttcaacaattatcagttccgttatcaaggaccaaaatgatttagtaaaagtggcagagtggaacttactgttgggagttttagctgtactgggtgtaccaattggtgcttatctgtccgatcgtattggtcgtaaatatacgttgatgtttggtttctctgggtacatcatctttggtctaatcattggatgtgcgtacgaccaattgaaaaaaatcacccccttgtttattatcttctacgcattcatgaatatgttaggtaatgctggaccaggtgatatgcttggtgttattagtagtgaagcgtcagcaaccgctgttagaggtgttttctatggtttatctgctgtgactggtaaaatcggttctgtagtaggcgtcgaatgtttccaacccattagggataatttgggtgcaagatggacttttattattgctgcaatttgtggtcttattggtatcattattacatatttctttgttccacattctcttgaaagcgatttaatgaagcaagacgttgaatttcacaactatttggtatccaatggctggactggtaagatgggatttgatgagacagatgaagaatcaatggttagaactattgaagttgaagagaatggtactaattgtagtaagaaaaacgcagaaataatttcagtcagacaggtcgatcaaagttga

SEQ ID NO: 49 - DNA, 2706 bp, Saccharomyces cerevisiae
atggttaatcctgttggatcctcgaaattggaacaaaacaatataaaaagcattataggatcatcgtacaatcgactatacagccaatttacttctgatgagttgacagaagtgggaaactacaagattttaaaacaaataggtgaaggaagttttggaaaagtatatttagcgctccatagaccaacacatcgtaaagtctgcctaaagacgagtgataagaatgatcccaatatcgttagagaggtattttaccatagacagttcgattttccttatattacaaagctttatgaagtgatagtgacagaatcaaaagtgtggatggcattagaatattgcccagggaaggaattatatgaccacttactttctctgcgtagaatatcgttattggaatgcggagagttgtttgcacaaatttcaggtgctgtttactatgcacactcaatgcattgtgttcatagagatttgaagttagagaatattttattagacaaaaatggaaatgcaaaattgacggattttggttttacgagagaatgtatgacaaagacgacattagaaacggtttgcggtaccacagtttatatggcacctgaattgatagaaagaaggacttatgatggattcaagattgatatatggtcattgggagtgatactatacacattaattacgggatatttgccatttgatgatgacgatgaggctaaaacgaaatggaaaatcgtcaatgaagaaccgaaatacgatgctaaagttattccggacgatgctagggatttgatctcacgattattggctaaaaatccgggagagcgcccatcgttgtcacaagttttacgccacccttttttacagccttacggttcagtggttttagatcagactcagaaaattttgtgcagacagcgcagtggagggactcagtttaaaagtaaattagaaaggcgattgctgaagcgtcttaaacaatcaggggttgatacgcaagcaataaaacaatcaattttgaaaaaaaagtgcgattcactctcgggtctatggttattgttgttagcccaagggaaaaagcaagaaaattgcaaatatccaaaaagaagcaggtccgttttatcagtcaaaaaagttattgaaagtgctacgcataacgacactaatggcattagcgaagatgttttgaaaccctcacttgaactttctagagctgcttcattgagtaaaatgctcaataaaggctcagattttgtaacatcgatgactccggttagcagaaagaagtctaaagattcagcaaaagttctgaatcctactctctctaaaatatcctcacaaagggcttatagtcactctattgcaggttctcctcgcaagtccaataatttcttacaaaaagtttctagttttttcaagtcaaaaaaaagctctaacagcaatagcaacaatagtattcacacaaatgttagtgaaagcttgattgcaagcaatagaggagccccatcttcagggtcgtttctcaaaaaaaacagtggttctattcagaaatcaagaactgacactgttgcaaatccttcaaggacggagtctataggatcgttaaacgaaaatgttgccggtgccattgtgccacggagtgctaataatactacattagaaaataagaaaacttctgggaatgaaataggcttaaaagtagctccagaactattattaaatgaacatatccgaatagaggaacctcgcctcaagcgcttcaaatcgtccatatcaagtgaaatatctcaaacttctactggtaattatgatagcgaatctgcggaaaattctaggtctatatcttttgatggaaaagtttccccgccaccgatacgaaatcggccattgtcagagatatcgcaaatttctaatgacacttatatatcagagtactccactgatggtaataattcgtcattcaaaatttcagacactatcaagccgagctatatacgaaaaggctctgaaactacctcgcagtattcagcttcatccgaaaaaatgacaaatggctacggtagaaaatttgtcaggagggatttaagcattgtatcgactgcgtcgagcacctctgaaagaagttcaagaacagattccttttacgatatcactacagctacaccagttgtgaccactgataataggcgcaataaaaacaataatctgaaagagtctgttttgcccagatttgggactcaaaggccatggactggcaaaaggacgtataccacgtcccgccatggcaagaatgctaggcgttcgtctaaaagaggtctgttcaaaataacttcttcaaatacagactctattattcaagaagtaagctcatcagaagaagaagatcataatgttatctatagcaagggaaagggtcttccaacaccagttttgcaaactaaaggattaatagaaaatgggttgaacgaacgcgatgaagaaggagatgacgagtatgcaattcacactgacggagaattttctatcaaaccgcagttttccgatgacgttatcgacaaacagaatcatttgcccagcgtgaaggctgtggcaactaaacgttcgttgagcgaaggaagtaattggtctagtagctatttggattcggacaataatcggcgaagggtatcttcattgctagtagaggatggggggaatcctacagcgtag

SEQ ID NO: 50 - DNA, 942 bp, Saccharomyces cerevisiae
atgccactggtgctttttacgggatacccatgtagtggtaagacaacgcttgctaaacatttggtacaactactacagtccaagatcgatgcaaccccatcattaagtaaatattccataacctatcattcagatgaatctttaggcataaaacattcagattatataacttcccaagatgaaagaaaattgaggtcggagatcatctccgcagtgaaaagagatctatctaaaaacaagatagtcattgtagactcgttgaattatatcaagggtttccggtatcaacttcactgcgaggtgaaaaatttgtccaccacattttgtgtaattcaaacactgtgtccaccagagactatattcgagtggaataagacttcaaacccgaacccttgggaacccgagttattgaatcaattgattcaacgatacgaagagcctaactcaagcaaccgatgggactctccactctttgctattcttactcctcaggacaacataactgactacatcgacgatatttgtaaagtagtctttcaaacttccaaatcggctaaaaacagtggacacaatgatccgttgagtaagggcttacaaaaaccgaactcagccacggtactaaagcctgcgtctcagtccaatttcatccaggttctcgacatcgaaactagtaagataataaaaaccataatgaaccacatcaaaagcctgacttctattggcggggtaagtaacggaacaagagtcattgtttccgaagggattaccgatatcaatgatgatggttgcttcttcgtagacttgcccattggtaacgtcgttacgttggcgcaattgcagagattgaaaaggcaattcattaacttcaacaaactaagagatatagatcaagataggatcggtccgcttttcgctgattatcttaacaaaaacttgaattga

SEQ ID NO: 51 - DNA, 765 bp, Saccharomyces cerevisiae
atggcttacactaagatcgctttattcgctgctattgctgctttggcttccgctcaaacccaagatcaaattaacgaattgaacgttattttgaacgatgtcaaatctcacttgcaagagtacattagcttagcttctgattcttcctctggattttccttaagcagtatgccagctggtgttttggatatcggtatggctttagcttccgccactgacgactcctacactactttgtactctgaggttgactttgctggtgttagcaagatgttgaccatggttccatggtactcctctagattggaaccagctttgaagtctttgaatggtgatgcttcttcttctgctgccccaagctcttctgctgctccaacttcttctgctgccccaagctcatctgctgccccaacttcttctgctgcctcaagctcttctgaagctaagtcttcttctgctgccccaagctcttctgaagctaagtcttcttctgctgccccaagctcttctgaagctaagtcttcttctgctgccccaagctcttctgaagctaagtcttcttctgctgctccaagctccactgaagctaagataacttctgctgctccaagctccactggtgccaagacctctgccatctctcaaattaccgatggtcaaatccaagctaccaaggctgtttctgagcaaactgaaaacggtgctgctaaggcctttgttggtatgggtgctggtgttgtcgcagctgccgctatgttgttataa

SEQ ID NO: 52 - DNA, 1407 bp, Saccharomyces cerevisiae
atggtgaagcccgttatttttgccatttgtttaggtgttctattatctaaggcactctccatcccactcagaagttttgcggatattgaactaattggctctcagaagagtctgtttccctttcttggagggtctgcgccatatttctcctttcccgctaactacggtatacccactgatattcctgaaggttgtagattaacgcaagttcaaatgattggcagacatggcgaaaggtatcctaccagaagtgaggccaaggatatttttgaagtatggtataaaatatccaattacacaggtaagtacgagggatcattatcgtttttgaataatggatatgaattttttattcccgatgaaagtcttctagaaatggagacaactttgcaaaattcgattgatgtgttgaacccgtatacaggagaaatgaatgcaaagagacatgcaagggagtttttagcaaaatatggaaaattgatggagaactgtaccaactttcctatcttcaccacaaattcgaaaagaatctacgatactgcgcaatattttgccgaggctttgggcgatggctttaatatatcacttcaaacacttagcgaaaattcctcgtcaggagcaaacacattagctgccaaaagttcgtgccccaattggaattcgaatgccaacaatgatatattaatgtcatattcgagggactacttagaaaatatttccgatcgtcttaatgacgaaaataaagggctgaacttgagcaggaaagatgcagcggccttgttttcttggtgtgccttcgagttgaacgcaaaaggttatagtaacatttgtgacattttctccgcggcagagttaatacattattcttatgagactgatttgacgagcttctaccaaaatggtcccggatacaaattgattaaatctataggtgctaatttgttcaatgcaacagtgaagctaatacgacaaagtgcgcacttggaccaaaaagtttggctgagctttacgcacgatactgatattctaaattatttgacaactgctggattgattgatgacactagaaatttaacaaccaatcatgttccctttcgtgatcattcctaccacaggtcgtggtacattcctcagggagctagagtctacacagaaaagtttcaatgctcaaacgattcgtacgtccgttatgtggtcaacgatgctgtggttcctatagagagttgctccagtggtccaggtttttcatgtgaagagggcacattttacgagtatgccaaagacagattacgaggtgtgagcttctatgaagattgcgacgtctccaaagttagcaaagaaaaggaattgacgttttactgggattggaacacaacaaggtataacgcatccttagtgaatcaataa

SEQ ID NO: 53 - DNA, 1863 bp, Saccharomyces cerevisiae
atgagggatattgtatttgtatcaccgcagctgtatttgtcatcacaggagggttggaaaagtgattctgccaaaagtgggttcatccctatcctcaaaaatgatctacaacgttttcaggactcattaaaacatatagttgacgccagaaacagcttatcagagacactgctaaatagcaacgatgatgggagtatacacaattctgaccagaatactggtttgaataaagacaaagaggcttcaatagcagataacaatagtgctaacaagtgcgccacaagctcttcccgttaccaagagctcaaacaatttcttcccatttccttagaccaacagattcatacagtatctttacaaggtgtctcttcatcattttctcgcggacagatagaatcattgctagaccactgtttgaatttagcgttgactgaaactcaaagcaattccgcattgaaagtagaagcttggtcttctttttcttcgtttttagatacccaggacatttttataagattcagtaaggttgatgaagatgaggcatttgttaatacgctgaactactgcaaagccttattcgcgtttattagaaagctacatgaggatttcaagattgagttacacttggatttgaacacaaaagaatatgtcgaagaccgaacaggaactataccgagtgttaagccagaaaaggctagcgaattttattctgttttcaaaaacattgaagatcaaacagacgaaagaaattcaaagaaagaacagttggatgactcttccacacaatacaaagtggatacaaacactttaagtgatttgccatcggatgctttggaccaattgtgcaaggatataatagaatttaggacaaaagttgtcagtatagagaaagaaaaaaaaatgaaaagtacgtacgaggaaagtaggcgtcaaagacaccaaatgcaaaaagtttttgatcaaataaggaaaaaccactcaggagccaaagggagcgccaatacagaggaggaggatactaatatggaagatgaagatgaggaggatgacactgaagacgaccttgccttagagaagagaaaagaagaaagagacctggaagaatcaaatcgtagatatgaggatatgttacaccaattacattccaatacagagcctaagataaaatccattagggctgatatcatgagtgctgaaaactatgaggaacatttggagaaaaatcgctcattatatttgaaggagctattacaccttgccaacgacgttcattacgaccaccatagatctttcaaggagcaagaggaaagaagggacgaagaggatagagctaaaaatggaaatgcaaaggaactggcgcctatacaactatcggatggtaaggccatatctgcagggaaggctgccgccatcacccttcctgaaggcactgtgaagagcgagaactataacgcggacaagaatgtgtctgagagctcagaacacgtcaagatcaaattcgactttaagaaggctattgatcactcagttgaaagctctagcgaagacgagggatacagagagagcgagctacctccaacaaaaccctccgagagaagcgcggcagaggaccgtttgccatttacagcagatgaactgaacataagactaactaatctgaaggaatcgcgctacgtggacgaactggtgcgtgaattcctcggcgtctacgaggacgagctggtggaatacattcttgagaacatccgcgtgaaccagagcaaacaggcccttttaaatgagctaagggagactttcgacgaggacggggaaacgatagctgatagactgtggagtcgtaaagaatttcgcttggggacctga

SEQ ID NO: 54 - DNA, 474 bp, Saccharomyces cerevisiae
atgtcatcttcaaacaaaaaatcgctaaacttcccggttttggtcgatcccaggacaggtaagctagtcatttccaatgaacgttgtcgtaccccatgtgccctattctttgtcacatataaatgtctcctatcatgcagcgcaggctgttcctccttttctttctccctttccttttgtaacaacgatcccaagtttacttcagtgcttggtcttgggaccaccggattatcattcactgctatgacaggtaatctagaagatgatttcgaaaagtgtgcaacatttgttttagcttgtagaggttccggctgcggctgcggctgtagaccggattcttttatcttcactgcgtcgccactggaagcccttcttcccttacaaaagcctcttgggaatgaaggaggtaacagggtacagttcctcgatccgggattctccatccggtcaattagcaagttcattttcacttaa

SEQ ID NO: 55 - DNA, 897 bp, Saccharomyces cerevisiae
atgtctagaattagtatattagctgtcgccgcagcattagtggcaagtgcaaccgccgcatccgtgaccaccactctatccccttatgatgaaagggtcaatttgattgaattggctgtttacgtttctgatattggcgcccatttatctgaatattacgctttccaggctttgcataagactgaaacatacccacctgaaattgccaaggctgtttttgccggtggcgatttcaccaccatgttgactggtatttcaggtgatgaagtgaccagaatgatcaccggtgtgccatggtactctactagattgatgggtgctatttccgaagcacttgcgaatggaggtattgctactgcagtaccagcttctaccacagaggcttcttccacctccacttcagaagcttctagtgccgccactgagtcttctagctcctctgaaagttcagcagagaccagctcaaacgctgcttccacccaagctactgtttcatctgaatctagctctgctgcaagcaccattgcaagttctgctgaaagttctgttgcaagctctgttgcaagctctgttgcaagctctgctagttttgccaataccacagctccagtttcttctacatcttctatctcagtcactccagtggtccaaaatggtactgacagcaccgtcacaaagactcaagcttccactgttgaaactaccataactagttgttcaaataacgtctgttcaactgtgactaagccagtctcctccaaagctcaatctacagctacttctgtcacatcgtcagcatctcgtgttattgacgttaccactaacggtgctaacaagttcaataacggtgttttcggtgccgctgctattgctggtgccgccgctctattgttatag

SEQ ID NO: 56 - DNA, 2508 bp, Saccharomyces cerevisiae
atgggtgaagaacataaaccacttttggacgcctcgggtgtcgaccctcgtgaggaggataaaaccgccaccgccattttaagaagaaagaagaaggacaacatgcttttggtggacgatgctatcaatgatgacaattctgtcattgctattaattctaacaccatggacaaattggaattgttccgtggtgacaccgttctcgttaagggcaagaagagaaaagatactgtcttaattgtgttgatcgatgacgaattagaagacggagcatgcaggataaaccgtgtagttcgtaacaatttacgtattaggctgggtgatttagttacaattcatccttgccccgatatcaaatacgctactagaatttctgtgttaccaattgctgatacgatcgaaggtataactggtaatcttttcgatgtttttttgaagccttattttgtggaagcctacagaccagtgaggaaaggcgaccattttgttgtcagaggcggtatgagacaagtcgaattcaaggttgtggatgtcgaacctgaagaatatgccgtcgttgctcaggatactattattcactgggaaggtgagccaatcaacagggaagatgaagaaaataatatgaatgaggtgggttacgatgatattggtggttgtcgtaagcaaatggctcaaattagggaaatggttgaactaccattgagacatcctcagttgttcaaggctatcggtatcaagccaccaagaggtgttttgatgtatggtccccctggtactggtaaaaccttgatggcaagagctgttgctaatgagaccggtgccttttttttcttaattaatggtccagaagtcatgtcaaaaatggctggtgaatcagagtctaacttaagaaaggcctttgaagaagccgaaaagaacgctccagccatcatttttatcgatgaaatcgattctatagctccaaagagagacaagactaatggtgaagttgagagaagagttgtctctcaattgttaactttaatggatggtatgaaggcaagatctaatgttgttgtcattgctgctaccaatagaccaaattcgattgatcccgctttaagaagatttggtagattcgatcgtgaagtcgacattggtatcccagatgctacaggtagacttgaagttctacgtattcacaccaagaacatgaagttggctgatgatgttgatttggaagcattggctgctgaaacacacggttacgtgggtgctgatattgcctctttgtgttctgaagctgccatgcaacagatccgtgaaaaaatggacttgatagatttagatgaagatgaaattgatgcagaggtgctcgattctttaggagtcaccatggacaacttcagattcgcattgggcaattcaaacccatctgcattgcgtgaaaccgttgttgaaagtgtcaatgttacttgggatgacgttggtggcctagatgaaatcaaggaggaattgaaggaaactgtagaatacccagtcttacatccagaccaatacacaaagtttgggttatcaccatcaaagggtgtgttgttctacggtccaccaggtacaggtaaaactttgttagcaaaagctgtagctactgaggtttctgccaactttatctcagtcaaaggtccagaattattgagtatgtggtatggtgaatcggaatctaacatccgtgatatttttgataaggcaagagcagctgcaccaaccgtcgtttttctagatgaattagactccattgccaaggcaagaggtggttccttgggtgatgctggtggtgcttcggatagagtcgtcaaccaactattaacagaaatggatggtatgaatgctaagaaaaatgtgttcgtgattggtgccaccaataggccagatcaaattgatcctgctattttaagacctggcagattggatcaattaatttatgttccattgccagatgaaaacgctagattatctattctaaatgctcaattaaggaaaacaccactagaaccagggctagagttaactgcgattgccaaggccactcaaggtttctctggtgctgatttactctatattgtgcagagggctgctaaatacgctatcaaggattctatcgaagctcacagacaacacgaagctgaaaaggaagtgaaagtagaaggtgaagacgtggaaatgacagatgagggagcaaaggctgaacaagaaccagaagtagatcctgttccatatattacaaaggagcatttcgcagaagctatgaagaccgctaaacgttctgtttcagatgctgaattgcgtcgttatgaagcatactcacagcaaatgaaagcatctagaggtcaattcagtaatttcaactttaatgacgctccattaggtactacggctacggacaatgctaacagtaataatagtgctccaagtggagcaggtgctgcatttggttctaatgcggaggaagatgatgatttgtatagttag

SEQ ID NO: 57 - DNA, 651 bp, Saccharomyces cerevisiae
atgcaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatattttgcatattatcttgcgagcatgtgcactcaatttcggggcgggtccccgtggtggcgctggtgacgaagaggatcgatctattacgaatgaagaacccattattccctctgtggacgagcatggcctgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcaatgtggaaatggatcaaaattctgtaccacgaagtagcgcaggaaaccacgctgaaggactcttatagaataactttggtaccttcttctgatggtatatcagatacccttaccgttatccagagcttcagctactcgcttttgccggtcctcagcgcaacgtatacgtcgatgatacaacaagacgcatccaactgtacactgattacaacaagaacggttcatcggagcctcgactaa

SEQ ID NO: 58 - DNA, 345 bp, Saccharomyces cerevisiae
atgactccgctgttcccagaaagtgtgagcacttacatatatgaatacagcactatctggagaagtggcgcgctcttaattaaaatgatgcagcgtgttatcacatcttgcgttaccgggccttgcaaaaattgctatgtttttcttgtgcttggtattgcttcgtggagatatatattctcatatcaggacggaattttacaaagtgagaactctaaatggtgtagtaaagagaagaaaaaaaaatgctcagcgatttaccctcattacaaccaccgagattcactaggaaacggagctgtccctcggaatttattgtcaacatatcatccaatgttaatgtag

SEQ ID NO: 59 - DNA, 552 bp, Saccharomyces cerevisiae
atgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttgcatagctcatctacgtgtaggctgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaacaagatactttga

SEQ ID NO: 60 - DNA, 1599 bp, Saccharomyces cerevisiae
atgaaagcattcaccagtttactatgtggactaggcctgtccactacactcgctaaggccatctcattgcaaagaccgttgggtctagataaggacgttttgctgcaagctgcggaaaaatttggtttggacctcgacctggatcatctcttgaaggagttggactccaatgtattggacgcttgggcccaaatagagcatttgtacccaaaccaggttatgagccttgaaacttccactaagccaaaattccctgaagcaatcaaaacgaagaaagactgggactttgtggtcaagaatgacgcaattgaaaactatcagcttcgtgtcaacaagattaaggaccctaaaatcctgggcattgacccaaatgtcacacagtacacgggttacttggatgtggaagacgaggacaagcatttcttcttttggacttttgaaagtagaaacgatcctgcaaaggatccggtcatcctttggttgaacgggggtccaggttgttcttcactaaccgggctgttctttgaattaggaccctcatccattggacctgatttgaaacccatcgggaacccttactcttggaacagcaatgccaccgtgatcttccttgaccagcctgtcaacgttgggttctcgtattccgggtcctcaggtgtttccaacactgtcgccgctggtaaggatgtctataacttcttggagttgttcttcgatcagttccctgaatacgtcaacaagggccaagatttccacatcgctggggaatcctacgccggccattacatccctgtttttgcctctgaaattttgtctcacaaggacagaaacttcaacttaacctccgtcttgatcggaaatggcctcactgacccattgactcagtataactattacgaaccaatggcctgtggtgaaggtggcgaaccatctgttttgccctcggaggaatgctctgctatggaagactctttggaacgttgtttgggcttgatcgagtcgtgctatgactcgcaatccgtctggtcctgtgttccagctaccatttattgtaataacgcccaattggctccttaccaacgtaccggcagaaacgtttacgatatcaggaaggattgtgaaggtggcaatttgtgctacccaacgttacaagatatcgacgactacttaaaccaggactacgtcaaagaagctgtcggtgcggaggttgaccactacgaatcctgtaacttcgatatcaacagaaatttcctgtttgcgggtgattggatgaagccttaccacaccgccgtaacagatcttttgaatcaagacctacccattctggtatatgcaggcgataaagatttcatctgtaactggttgggtaataaggcgtggacggatgtcttgccatggaagtacgacgaagaatttgcaagccaaaaagtacgtaactggactgcttctatcaccgacgaggtcgctggtgaagtcaaatcctacaagcacttcacctatttgagagtcttcaatggtggccacatggttccatttgacgtccctgaaaacgccttaagtatggttaacgaatggatccacggtggtttctccttataa

SEQ ID NO: 61 - DNA, 1107 bp, Saccharomyces cerevisiae
atgaaactggatagtatagacattacacactgtcagttggtcaaatctactagaactgctaggatttataggtcggatacatatgccattaaatgtctagcactagatttcgatatcccgccacataacgccaaattcgaagtatcgatattaaacaaactgggcaacaaatgtaagcacatcttacctcttctagagtctaaggctaccgataataatgacctattgttgttgtttccctttgaagagatgaacctttatgagttcatgcaaatgcactataaaagagatagaagaaaaaaaaatccctattacgatttgctaaatcccagtatcccaattgttgcggacccccccgttcagaaatatactaatcaattggacgtcaatcggtattctttgtcctttttccggcaaatggttgaagggattgcattcttacatgagaacaagatcattcaccgcgacatcaaaccgcaaaatatcatgctaacaaacaataccagcaccgtatccccaaagttgtacataattgattttggcatctcttatgacatggcaaataactcacaaacaagtgcggaacccatggatagcaaggtgacggatataagcacaggaatttacaaggccccagaagtgctttttggagtaaaatgctatgatggtggcgtggacgtgtggtcgttgttgataattatttctcagtggttccagagagaaacaagccgtatggggcacgttccggccatgattgatgacggcagcgacgacatgaactcagatggaagcgatttcagactgatttgctcaatattcgaaaagttgggcataccgtccattcagaaatgggaagaggttgcgcaacacggctcggttgatgcatttgttggtatgtttggtgcagatggcgatggcaagtatgtactggaccaggagaaagatgtacagattagcattgttgagaggaatatgcctcgactggacgagattgcggatgtcaaagtcaagcagaagttcattaattgtatcctggggatggtttcattttcaccaaacgaaagatggagctgtcaaagaatcttgcaagaattagaaaagccataa

SEQ ID NO: 62 - DNA, 1647 bp, Saccharomyces cerevisiae
atgtatataaaggcagaacagaaaccccaacagtttgagaggaagaatgaaaaactagacagaaataaaaaccagcagctaccagatcttgaaacagatttcaagggttacagagtgaattcggacctatacaacaaagaacgagatggaagtacggaagagactttaaactctttgaagtttttacataaacctcagagagtaactcaaatgagagcgaacaggttcccagaggaagaagtgcaaagaaacactgatttaaacaaaagaattttctccgcagggaatgatgaaaacgttgataatgagagcggctggtcaaaaattgccgctgccaagaatcacacttccgtagaatcattaaatggcagtacgagacccccattcaaaatagagctgcctcccctttcccccaaatccaccgtaccaaaatcttttcaagcagaatatcccgaagctaagtcacctggcaatgatatgaattttgaatatgatgaagaaattctaattccatttgcgccacctgtatataaaaagtcaggtgaactattgaagagctcattgaagagaagatcaaaatcattacctacaaccccaggtataaggagcgggaatggtgtccaagcaagagacggtagtccgatgttgattaggagtaagagtgttcactttgatcaggcggcacctgtaaaatattttgctgaggatgaaagccctataaacgttaataaaactgaacaacacgataattgtctaagctttaagcataagccagtgaatttaatggtggacccggaagaagagacaaaaatgctatcatctggattagaaacgacatccatagatgatgacttgacgacagttgcgccaaaaggcttcgcacatcctgctaaaatttcgaatccaaacaatggtaaaggcaccaacaatacaaaattaagaaaaagtaaaagatttcagaacctcctaaagaacaggaccgacatgccaccatcaaaatcaaataaaaaattcgttaatggtggcggtgctcatgaaatttcagatcgtaattcaaaaaattaccatgttgttggattatacagcaagaacttccccattttaagcaacaagaatcctaaaagtttaaagctgaacatttttatcaatttatcacaaaataagaaagtttttctacaagaattgtcattatacatccatagagacaacaattacttttcaaattcctcctcattttataatattcccaatagccacaatggtaatgactgtaatggtgtggccaagggttataacgctggctgtacaagattaattgctggaaggatactagtgaaaaacattttctatgataaaagagtggtggtacgatatacgtgggatagttggagaacaacacatgaagtggaatgcgtttacatcagtgatggcgatggaatattgccgggcactaacatggacattttccacttcattatcgatgatgtcagcaaagtggatcctcgcggcaagttagaattttgcattcattattctacacgtaacgactatgagcgcgaagagtactgggacaacaacaacgggaataattataaggtggatgttgtaatggatggctttaacgatcccttcgcggcggcagcatga

SEQ ID NO: 63 - DNA, 1593 bp, Saccharomyces cerevisiae
atgccagaaaagttagccatgtcaatggtcgatataaaagatgcggggagtgaactaagggacctcgaatctggagctctggacacaaaatcttccgccgctgatgtatactatgagggtgtagaattgcatagaaccaacgaattcattgataataagccgtcctttttcaataggattgcagctgctttaaatgctgagacgaaaggtattgaaccagttacagaagatgaaaaaaatgatgactcgatactcaatgccgccactatatggttttcagctaatatggtgattgtagcctattccgtaggtgccttgggtcctctagtatttggcctaaatttcggccaaagtgttttagttatcatttttttcaatattttgggtttgatccctgttgcattattctcactttttggggtagaactgggcctaagacagatgattctatcgagatatttggctggtaacatcacagcaagatttttctctcttgttaatgtcattgcttgtgtcggttggtgtgttttaaatatttctgtttctgctcaacttttgaatatggtgaatgaaggctctgggcacaactgtcctatttgggcaggttgtttgattattgctggtggtaccgtgcttgtgactttttttggttacagtgtcgttcatgcatacgaaaaatggtcgtgggtacccaattttgctgcctttttggtcattattgcccaactatcgagatcaggaaaatttaaaggtggtgaatgggtagggggtgcaactactgcaggtggtgttctttcttttggttcatctgtttttgggtcagctgcgggttgggcgacttatgcagcagattacactgtttatatgccaaagaccacaagtaaatacaaaatttttttttccgtagtagccggtctagcgttccctctatttttcaccatgattcttggtgctgcttgcggtatggcggcccttaatgacccaacctggaagtcatattatgataaaaacgccatgggtggtgtcatatatgctatcctggtccctaactctctaaacggattcggtcaattctgctgtgttttgttggctctttcaactgttgctaataatgtccctggaatgtacactgtcgctttatccgctcaagctttgtgggcacctttggctaaaataccaagagtagtctggacaatggcaggtaatgctgccactttaggtatttccatccctgctacctattactttgacggctttatggagaattttatggattccattggttattatttggctatttatattgccattgcatgttcagagcattttatttataggcgttccttcagtgcttacaatattgatgattgggataattgggagcatctacctatcggtatcgcaggtactgctgccttaattgctggtgcctttggagtagcgttgggtatgtgccaaacttattgggttggtgagatcagtcgtttgatcggagagtacggcggtgacattgggttcgagttaggcggaagttgggcgttcatcatctataacattgtaagacctttagaactcaaatatttcggtcgatga

SEQ ID NO: 64 - DNA, 651 bp, Saccharomyces cerevisiae
atgcaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatattttgcatattatcttgcgagcatgtgcactcaatttcggggcgggtccccgtggtggcgctggtgacgaagaggatcgatctattacgaatgaagaacccattattccctctgtggacgagcatggcctgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcaatgtggaaatggatcaaaattctgtaccacgaagtagcgcaggaaaccacgctgaaggactcttatagaataactttggtaccttcttctgatggtatatcagtatgtggaaaactttggggagagttgaacaactgcttccatatgccagcctcattttgcgtaatcgagaagttttgttcagagaaccgaagcgaggaattgacgagtatctggaaaacgattcttttcttcaaatga

SEQ ID NO: 65 - DNA, 1665 bp, Saccharomyces cerevisiae
atgacacctaacttaccagggttttattatgatagagaacgtcgacgttattttcgcatatctgaaaatcaaagcatttctaccacgggaacgacgaaccagtacagaaaagataatataaagcgacaatgtgttgaggaaaattacgataaaaaattttctatgattaaaaaaaaacgtcagcaaacattacaaaagtacaagcttagtcttctgaatccgttggaaagggcttttcgccctttatcatatgaaaagtacatgattggtttaaatatgcagtatgcatcgcattctctcactgaaggtcatcactcacatagttctgctaacgtaaaatcactcaattttccacacaggatacagataggagtattagcaaattgtattttattggtaactcaagaaggatgttttcatagtaaattagtatttgcaacaaacaagggctatgtcgcaggattttcatccctggataatttttctgaagaaaatttctttacggggttttccatggctgaattaaatcctatgttgaaatataagtccgagccaactgatgtgttcaaaacaatgaaacttgagagaacagttgccatcaaggaagggccgagccattatttttatcacaacgttaataccagatctaacgtgcatacttttgccatctttttacaagacttttcttccttaaaactgctcaaaattcgtcaggtcaaactcaaagaaaattgccaagtccatgattctcttgttgttggagacacgttgattattaccgtaaattatcgttgtcatttttatgatttgattccagaaacctttccaaatccctatatcttttctcctgccaaaagctcaagaaaacacaaaagtaggagtgacattacttccctatcattttgtctacaagaagatgctttatcacctttaaaaaaaacgaacaccggtgtgttttatttaggttacagaaatggtgattcaatggcaatagtcttcactaatattacaaacatgacattacagtactccaagaccaacggtatgacatcagaaagtcgaaatcaacctatcagaaattccctaaaatctgttgtttccataaaagcattgaataataaaggcctaatacttatatctggaatggcagacaaagagaatgtgcaacaactggttatagcagatacgttcctggaggacattctgaccgaaatcccggttgtatcttttaaaactaagttcttaaacgtgactaaggatacagaaatactcgagatatcggatgacgggcgctacttcatttatggttcaactagcgctagggacggaaagggtgattttgaagtattttgtaccactttatctggaaatcttgactacgaaaaatccgaaggtggaaatatcaccctctatccaataggaggtatgaagaactactgtaggttagaaaacttccagtttgaatctatccacctacattcggctttcatacccccaaggtacgtaaatccgtttgatgctgtggaacctctaggtgaagagagcagtacttcaccttacgatatacctgaagaagcactttctcaaaaaatatgcatcttaattcggagagaagatgatccctacaatggggccaatatcttcataacatctgctttgacctag

SEQ ID NO: 66 - DNA, 405 bp, Saccharomyces cerevisiae
atggtctttaccagctcagaaagttcttcgttgctatcttctcttaaaatgacatgttccatggtatccatgaactctctggaacaaatttccttaataaaaggcgttccaccattttttacacatatattggtaagcttccaggaagacaattgggtatttggattatcggccgtattgagaatccttttctttatacaacgcatagaatctttgggatttacccttctagatcttaacacatctgaaatttccaacgctatggggagatcaaggtcaccgttgggaatgctctcactagtggcttgttctattaatgcgtctaactcacttggcgtgctaacggacatactgttcttagttctttactcactactcattcaccttagcaaaaaaaaatcttga

SEQ ID NO: 67 - DNA, 336 bp, Saccharomyces cerevisiae
atgatcaaaagggaaactaggttaagagctaaaatattgggaataaatgccaatgccagttcccataacggtgagtgtggcaacgccagcagtgaaatcaccacagtttggataatagaacatatgaaaaacaacctcgtaactaaatggttgaatcgggtcttgcacacgtcgctaaagatggtatggtacgtgtaccgtggattcaacaactcccttggcgtctgtatcatctgcttgccctgtaatgtcctttcgtcttctcaatcacacttactcatcgccaaagagtctgctcttcccgttagtgattctcgatgttattatattctttag

SEQ ID NO: 68 - DNA, 366 bp, Saccharomyces cerevisiae
atgtcttcctgctctgtgtcttcattacgacggaagcgatctgaagaggtaatatcgtttgtggtttggtttatgccaggtgaatccttgctacttaatggaaatgcagaatcggttttggaagttagttcggtaacaaatgtagtagattctttttcattctcgaaggctggagaagtagccggcttgaatccgtcaactacatctgcccaatattcctttttcaatgggtttctaggcatttttgattttgaggttgtatatctgtatttgtgtactaatgagtcagatagcgataatattatacgtcaaaaaaacttgggaaggacaatgaattgtaataacgctgatgatatgttgttttga

SEQ ID NO: 69 - DNA, 597 bp, Saccharomyces cerevisiae
atgacaggttactttttaccaccacaaacaagttcttacacgttcaggtttgctaaggtcgatgactctgcaattctatcagtcggtggtaacgttgcgttcgaatgttgtgcacaagaacaacctccaattacatcgacggattttacaatcaatggtattaagccatggcaaggaagtttgcctgataacatcggagggactgtctacatgtatgcaggctactattatccgctgaaggttgtttactccaatgccgtttcctggggcacgcttccaattagcgtggaattgcctgatggtactactgttagtgatgactttgaagggtacgtttactcttttgacgatgatttaagtcagtcaaattgtactatccctgatccttcaaaacatactactagcatcgtcacaactactaccgaactgtggactggtacttttacttctacatctactgaaatgaccaccgtcaccggtactaatggtcaaccaactgacgaaaccgttattgttgccaaagctccaaccactgccacctcatccagtttgtcatcatcttcttcagaacaaatcaccagctctatcacgtcttag

SEQ ID NO: 70 - DNA, 1554 bp, Saccharomyces cerevisiae
atgactacgtttaggccactatcaagttttgaaaaaaaaattctcactcaatctttgaatgaccaaagaaatggaactattttttcgagtacatattcaaaatctttaagtagagaaaatgacgctgactggcattctgatgaagtcacgctcggaacaaattcttccaaagatgattctcgtctgactctgcccctaatagcaacaactttgaagagattgattaaatcgcaaccggcattgtttgcaactgtaaacgaagaatgggaattcgagccattgaagcagctgaaaacttccgatattgttaatgtgattgagtttgaaaccataaaagataaggaggtcaattgccattggggtgttccacctccttatctcttgcgtcatgccttcaacaagactagatttgttcccggatcaaataaacctttatggacactatatgtaattgacgaagcgctattggtttttcatggtcacgacgtattgtttgatatattttcagcagctaactttcacaaattatttttaaaagagttaaacgaaatcagcacagtaacacactctgaagataggattttgtttgatgtcaatgacatcaatctctcagaattaaaatttcccaaatcgatatatgatagcgcaaaattacacctgcccgctatgacaccacaaatcttccacaagcaaactcagtcatttttcaaatcaatatactataacactttaaaaagacctttcggctatttaaccaatcaaacttccctcagctcgtcagtatctgcaacacagctgaaaaagtataatgatattctaaatgcgcacacctcattatgcgggacaacagtatttgggatagtaaacaaccaaaggtttaactatttaaagtcaatcgttaatcaagagcatatatgtctaagaagtttcatctgtggtattgcaatgatatgtttaaaacctctcgttaaggatttcagcggtacaatagtatttactattcccataaatttaagaaaccacttaggcttaggtgggtcattgggtctcttcttcaaagaactaagggtcgaatgtccactttctctaattgatgacgaactttccgccaacgaatttttgaccaacagtaacgataacgaggataatgatgatgagtttaatgaaagattgatggaatatcaatttaataaagttacaaagcacgttagcggttttattatggcaaaactgaggagttgggaaaagaatgggtttaatgatgacgatataaggaggatgaagtatgacaatgacgacgatttccatatccaaaattcaaggacaaaattgattcaaatcaatgatgtttccgacatatcgttatcgatgaacggcgatgacaaatctttcaaaattgtaagtacgggatttacaagttcgataaatcgccccacattaatgtctctttcctatacatactgtgaagagatgggcctgaatatctgtattcactaccctgattcgtataatttagaatcttttgtagaatgcttcgaatcctttattgaatag

SEQ ID NO: 71 - DNA, 315 bp, Saccharomyces cerevisiae
atgttgttcaaaccaaaaacacgagcaataccatcaccgactgcaagaactctaccagtttcgttcaaattggcctcgtcggacacacccttaattctttcctctaagatggaggaaacttctgtgggttgtgccttggtggaagccaatcttctggtggaagccaaagcagcagcggcaggtcttgcggccttggtagagttaattagagttctcgatagagaacgaatagcagcagtacgagccaacattattatatgtgcgtgttttttttatttattttgttactgttcttgcgatagttatgagagctga

SEQ ID NO: 72 - DNA, 5619 bp, Saccharomyces cerevisiae
atggaagattctgacctgtctataaccaatataagagattttcttaccgagctccccaaactcgcgaaatgcgaatatagcgaaaccactagttatttactatggaaaaccttaaatctacgccttaagcatagtgataacgatataaactggcgctctctcgtttcaatactcaattctgaagcctgggaaaacgaaaagtacagagacatactaaatggaagaaagtggaggaccctggagttcgagaatgaccaccactctgtgggtaatatgcatattggaacagcgtgtacgcgtttatgcttcccctctgagacaatttattactgttttacgtgctccacaaatccattgtatgaaatatgtgagctttgtttcgataaagaaaaacatgtaaatcattcttatgttgctaaagtggtaatgcgcccagaaggcagaatatgccattgtggtgacccctttgcctttaatgacccaagcgacgcgttcaagtgcaagaacgaattaaataatattcctatttctaacgacaatagtaacgtaaccgatgatgaaaacgtaatctccctattgaattatgttctggattttttaattgatgtaactgtttcatacaaagaggaggcagaagcccattcaagcgagagaaaagcatcctccctaatgcatcctaatcaaaacagcattactgatgatataatggaaaaacacgaatgtgaaccattggtcaatgatgaaaattttgttttctttgataacaattggtccaatacgagaaaagaagcacatatggagtgggctattcaaatcgaagaagaagagtgtaacgtacactacatggatttagcatctacaataacgagaattttgaatacaccggttgaatatgcaatctcaataacgaaggctttagaagattcacacgatgtagtgactgtgctacaaagtgagaattttttcgaaatagatcaaatagccaaggagtttcaaaaggaaaacatagtagttcatgtaagaaaagcggatgatatattcaagagaaagttaacagatgatttaacagattggttatattctctgtgctttaaggcggccacgtctttgcaaaataaatatgctcttagaatttccatgctagatgtttggtattcccatttttctaaaatgagagtatctcccacaaataccaatcctgacttttctaagattaacttattaggtggattcttaatatctaacgaagatagtgatgaatcatggtttaaaccttggtcattagagaacattgaagacgaaagaatttcaaaaatactcactaattacaatgaaaggttgatcagagcccattcgccgaacacagtaagccatttctacaatttctatggatctagattccaatatattatcatcaattctattaatatcctctcaaaaaaatctaaattcaaaatgttaaagatcatggcgtcattattctcgttaagggatgaaagcagaaagtttcttgccgcacaatatattgatgtttatctatcggtcttgtatgatgcagttgcatcagatgctaaagaatgtcaggtaactcttatgagtatattagggcaatacactttccaagaccccagcatagcaaatatgactataagctcgggattcattgaacgaactattagatttgcttttactctcatggcattcaatccagaagacttgatgtcatatttgcccatctctttatacaatggctttaagttgcccaccgaaacaatacgaaatcgaaggacaattatttgctttaaagacctttgtacgataatgtcagcgaacactgttccggaagaactactttcaaatgaggcaatttttaacgcaataattgagtccttctctgaattcagtaacgtgctgccattgaaaagggaaactaaagaacacgtggaggttgaaaactttgatttttctgcattttatttttttttctcatcaatactaataatgacagatggatacacacgtagtatatctttggtcaaagatgcggctttccgtaagcaaatcgtccttaaactacttgatgttgctcaaaccagggaatttgaatcactaaccaattctagaaaagctatatcacctgataacgcatcaacgaatgaaaatgattcgaacaaagcgactttgtctacagtcagagagacgatatgcaattatgtcgcagagactattaatttccaggtaggtgtaaatacacagtattttttcaatccaatgtcatatttgttcaaatttgttattcaatggagtcaatgtggtagatatgagccaattcctgcttctttgacaaactacattaatctcttcgaagtttttcaagataagcagaaggctttatatatatcagaatctgctttgtcaaccctagtcctaatcgggcaaataaacgtcggtttctgggtaagaaacggaactccaattactcaccaggcccggatgtatacaaaatacagtatgcgagaatttacttatattagtgacattttcaatgtgcaatttagtatggcaatgtgcaatcctgatgaactgatggttacttacctctcaaggtggggtttgaagcactgggcaaatggtgtacctatgtatgattatcctgatacagaaacaactgtagccgttgttaatgaatgcattctgttattgattcaattgcttactgaagtgagatcattggtcatgaaatcatcaaaggaaggcttcgagagaacgttcaaatcagaaataattcatgccctttgctttgatacatgctcttacgcacaaattgttaactgtattccagaacatatcaccaagcacccttcatttgatatatatctcgaaaaatacgccaattacacttctcctgtaagcttgactgacaatggcattttcgtgttgaaagaaaagtataaagatgagattgatccttattatatagggttgtcttccagtaggaggtatgatgtagagaaaaatatcaggctgaatatggcaaatttgaagaaaatgaaatatgaagatacttttgtaccagcaaaaaaggttaaagatttgttgaagaatacattattttctgggctgtattcaatatcatcagtgaatacttttggtttatttttgaaaaatactttagatcacattataaaatatgattatgacaatttattgccgagagtggttcatttgattcatttatgcgtggttaataatctgaatgaatttatggggatactgtggcatgaatacgcaattgtggacacagaattctgtcattaccacagcattggttctatcctgtattactgtttgttgaaggataatttttcggaatctcatggtaagattagggaaattttcaggtatttaatggaaacagcgcctcacgtaaatgtaaacagttatttgagggagcaaaccacgtcatatacaccaggaatattgtggcctacaaaggaagataaaagccacaaggataaagaatttgaaaggaaaaaacatcttgctcgattgagaaagaaaaaattaatgaagaagttggctcaacagcaaatgaaattcatggaaaacaatagtgtagatacttccgatattagtacacccagaaccacatcacctagtttatctcccactagaataaatgcagagaatagtagtaacacaatcaacagttgctgcgatgatgattgcgtattttgcaagatgccgaaggatgacgatgtatttgtttatttttcataccaagaacggaacatatgtgatcatggaattgattttacgaatcctacagatgttaatagaataaattcgctgttcagtggtaagcaaacaaaagacagtgcaatccaagaaaacccccaggatgatgatggaacgagattgaaatttactagctgtgaaccagtattaagagcatgcgggcatgggtctcataccaaatgtttaagtggccatatgaagtcgattcgcggaatacaaaaccaaactacaaaaaatattccattatcgtatggttcagggttgatatattgtcccgtatgcaattccttaagtaattcatttctaccaaaaacaaatgatatagataagagaacttcgagccagttttttatgtgtattgaaaagcgaagtgaagcggaagaaaaccttgacccaatgagctctatttgtattaaagcagcgatgattctaggtgatcttcagggtaaaaaagtcacgactatcgaagatgcatataaagttgttaatagtgtttttattaatactatttcaaatactgagctcagattaagatcgcacaaaaaggaaggaaaaatagtgaatatggaaagaatatccagtcagtgcattttaaccttacatttagtttgtgagctaaagtcgtttatttacaaaaaatttgttaattcaaaaacattcagcagcgaaatctctcgtaaaatatggaattggaatgagtttctaataaagggtaataatgtgaatctacttttgtatatgagtcaaaattttgataatattgatggaggaaaaaccccgcaaccgcctaacctatgtatctatgaaatgttcaaaagaaggttccatcaactactactgttgcttgcaagagatatgatgagagtaaacttttacaaagactgtcgaaataaaatcaaaatatcatcaaacggatctgaggaaccatcgacaagcttttcatatctattcaatacttttaaaaagtatgttgatctctttaaaccagacgacgttcggtttgattttacaagtttagagaaaattaaagactttatatgctctctattactagagtcattgtccattttttgtagaagaaccttcttattattcaacattcagtatgatgatgatggtgatggtgataataataataaccgcagcaataatttcatggacgtcaaacagcgtgaaatagagcttattttccggtattttaaattacccaatttaactcactttttgaaggattttttctacaacgaactaacacaaaatatagaaaggtataatgatggtaatgataatttgagaattcagcaagtaatatatgacatggtgcagaacataaacacaagagcatatccttcaccagagcatatccagcttatcgaactaccattgaacctttccaaattttcccttgataatgatgaaatatcgaataaatgtgataaatacgaaatcgcagtatgcttgttgtgtggccaaaaatgccatattcaaaaaagcatagcactgcaaggttatttacagggggaatgtactgatcatatgagaaatggatgcgaaatcacctccgcttacggagttttcttaatgaccggcacaaatgcgatatatctgtcatacggcaaaagaggtacattttatgctgcaccttatctaagtaaatacggagagaccaacgaagactacaaattcggtactcccgtctatttgaatcgggcgagatacgcgaatctagcgaatgagattgtttttggcaacatgattccgcacatagtgttccgactaacggacggcagtgcagatcttggtgggtgggagactatgtag

SEQ ID NO: 73 - DNA, 2505 bp, Saccharomyces cerevisiae
atgacgaatatggcggaggataaaacaagtataagcaaggtacattctgaattcagcaattcctcgaataccactggatctgaagaggagagtcggtcgcatcaagagagcttcgacggcgagtccagttccggtgaaagtaaaagtaaaagcaaactaaatcttgaatattctgcagatatcgagccattgaagttcagaatgacaaaaactaataatacaaatgacaaattaaaatatagtaacaacggcaacgccactgattcatttatgagactaaaggaacatttacagagaggcaatactttaaattcgaatcttagggtcaatgagttttaccctttcaattccattgatacagagcaatttgaaaactatttgagagagccaaaatacattaaaatgttgaaacgtcggaaaaacctgaaacaatttagaagattgtttctcgcgcaagaactaatggcctacgaaggtgaaacggttacctccacttccaaatcatctgaaccaacctctaaagctatatggagtacaaagtttagccgcgatggaaaatttatggccactggtagcaaagatggtaaaataagaatatggaaagttattggctctccagttgaaagagccgaattggactcgagtgcggaatcaaataaagaggcacgagccaagtcgatgcggatcaaacagcaggtcagttcattgaacaatccaaaagaaaaacaatttttggattctgctacagagaaatacgaagagaaggaaaaattattgaatttgtatgcgcctgtctttcacccaacgcctttgcgactgtataaagaacacgtgcaagatgttctggatataaattggtctaaaaataattttattttgtcagcatcgatggataagacagtaaaactatggcatcccgataggaaaaattcacttaagacattcatacatcctgattttgtcacttgtgtggaatttcaccccaccgacgatagatttttcattagcggctgtctggatcacaaatgcaggttatggtctatactggatgatgaagttagctttgagtacgattgtcaagacttaataacatctgttacattatcccctgaggagggaaaatacactataataggaacatttaatggatacgttcatattctgatgaccagaggtctcactccagtttcttcatttcacgtagctgatagacaaacacaagaacaaaacgctcacgtcatggtcacggaaactgactcaaaaattcgtcatggtccacgtgtgacgggtttgcaagcttttagatctcaactggacaattctttccgcttagtagttacatcgaatgattcgaggataagaatttttgacttagaacagaggaagcttctagaggtattgaaaggcttccatagcggatcttcccaacacaaggcacaattgtccatctggcatggtcagccaatcgttgtaaatagtagtgatgaccattgggtttacggctggaggttaaagtcttcggatagagagaatgatcaagacgaacctaaaaggaaaccaaagggattggctcggtccggaagtttgagaagcatatttagtaaatcaatgagtaggtcttccagccagaataacgaagaaaaaccacatcatcatttaaaacttactaacttacttcccttgcctcatcatagcaacgatcattatatcaaaaatacggattacatttcttttcatgcacacaatgcccctgttacttgtgttagcattgcaccgccagaaacttcgaaaacattatctttgtctaacgatgttatctgcgagctatctctagagttttttcagacatccgatagtttcgatgttttgagtcggagtaacgacgatggcataatgtcagatgtagagtcgtctttgggctacaattctaaaccaggctcaatttctaatgcttccgccaccagtgctatcccagatgtcgttgacgcaattggaacgatattgatcagtactgataacgtagggactattcgtgtgtttagagcagatatgccctctgttataagaaagcgcgtgttactcaaactagaagaatacaatagagaggttcggagaaggtttaacagttctgattctttgcattctttgagtcgaagcttcaactcgagagcgaaatcaaacttggctggccaaccggcagcggcgtatactaatactggaaaaggctatgcaacgggacgtggatactctaatatatgtcccaaaagcagtacatcactaaaaacactcggcagtaatgcacagccaagaacaccaagggaaagcatgtcatctattttctccaatgcacatgggcctaccactccaacgagcgcaatgaatttacctatccgttgcaatgtttgtaacggttcaaggtttgaggctttttctggtgctaatgaccaacaagatagaaactattattgcgtagactgcggtacagtagttaataacttccgctaa

SEQ ID NO: 74 - DNA, 1608 bp, Saccharomyces cerevisiae
atggaagatatagaaggatacgaaccacatatcactcaagagttgatagaccgtggccatgcaagacgtatgggccacttggaaaactactttgctgttttgagtaggcagaaaatgtactcgaattttactgtttacgcggaattgaataaaggtgttaataagagacaactaatgcttgtcttgaaagtattacttcaaaaatactcaactcttgcgcatacaatcattcctaagcattatcctcatcatgaagcgtactactctagcgaagagtaccttagtaaaccttttccacagcatgatttcataaaggtgatttctcatcttgaattcgatgacttgattatgaataatcaaccagaatacagagaagtcatggagaaaatctcagaacagttcaaaaaggatgatttcaaagtcaccaataggttaatcgaattgattagccctgtaatcatacctctgggtaatccgaagaggcctaattggagattgatttgtttaccaggtaaggatactgatgggtttgaaacgtggaaaaacttcgtttatgtcactaaccactgcggctccgacggtgtcagtggatcgaattttttcaaagatttagctctactcttttgtaaaatcgaagaaaaagggtttgattatgatgaagagttcatcgaagatcaagtcatcattgactatgatcgagactacactgaaatttctaaattgccaaaaccgattacggatcgtattgactacaagccagcattgacttcattacccaaattctttttaacaaccttcatttatgaacattgtaattttaaaacctccagcgaatctacacttacagctagatatagcccctctagtaatgctaatgctagttacaattacttgttgcatttcagtactaagcaagtagaacaaatcagagctcagatcaagaaaaatgttcacgatgggtgcaccctaacacccttcattcaagcgtgctttcttgtagccctgtatagactggataagctgttcacaaaatctcttctcgagtatgggttcgatgtggctattccaagcaacgcaagaaggtttttaccaaacgatgaagagttaagagattcttataaatacggctccaacgttggaggttcgcattacgcctatctaatctcctcattcgacattcccgaaggtgacaatgacaagttttggagtcttgtcgaatactactatgaccgctttttagaatcgtacgacaacggtgaccacttgattggtctgggggtcctacaacttgattttatcgttgaaaacaagaatatagacagccttcttgccaactcttatttgcaccagcaaagaggcggtgcaatcatcagtaatacaggacttgtctcgcaagatacgaccaagccgtactacgttcgggatttaatcttctcgcagtctgcaggcgccttgagatttgcgttcggcctaaacgtttgctccacaaacgtgaatggtatgaacatggacatgagcgtggttcagggcactctacgggatcgtggcgaatgggaatcgttctgcaagctcttctaccaaaccatcggcgaatttgcgtcgctttaa

SEQ ID NO: 75 - DNA, 939 bp, Saccharomyces cerevisiae
atgggccgtacaacttctgagggaatacacggttttgtggacgatctagagcccaagagcagcattcttgataaagtcggagactttatcaccgtaaacacgaaacggcatgatgggcgcgaggacttcaacgagcaaaacgacgagctgaacagtcaagagaaccacaacagcagtgagaatgggaacgagaatgaaaatgaacaagacagtctcgcgttggacgacctagaccgcgcctttgagctggtggaaggtatggatatggactggatgatgccctcgcatgcgcaccactccccagctacaactgctacaatcaagccgcggctattatattcgccgctaatacacacgcaaagtgcggttcccgtaaccatttcgccgaacttggtcgctactgctacttccaccacatccgctaacaaagtcactaaaaacaagagtaatagtagtccgtatttgaacaagcgcagaggtaaacccgggccggattcggccacttcgctgttcgaattgcccgacagcgttatcccaactccgaaaccgaaaccgaaaccaaagcaatatccgaaagttattctgccgtcgaacagcacaagacgcgtatcaccggtcacggccaagaccagcagcagcgcagaaggcgtggtcgtagcaagtgagtctcctgtaatcgcgccgcacggatcgagccattcgcggtcgctgagtaagcgacggtcatcgggcgcgctcgtggacgatgacaagcgcgaatcacacaagcatgcagagcaagcacggcgtaatcgattagcggtcgcgctgcacgaactggcgtctttaatccccgcggagtggaaacagcaaaatgtgtcggccgcgccgtccaaagcgaccaccgtggaggcggcctgccggtacatccgtcacctacagcagaacgtgagcacgtga

SEQ ID NO: 76 - DNA, 588 bp, Saccharomyces cerevisiae
atgtccgggtcgttaaaatctctagacaagaaaatagctaaaagaaggcaggtgtataagcccgtgctagacaatccgttcacaaacgaagcacatatgtggccgcgcgtgcatgatcagccattgatttggcagctgctgcaatcctctatcataaataagttgattcacattcaatcgaaggagaactacccttgggagctgtatacagatttcaatgaaattgtgcagtatttgagcggcgctcacggaaacagcgacccagtatgtctatttgtgtgcaataaggaccctgatgtaccgcttgtgctcttgcagcaaatcccgctattatgctatatggcgcccatgacggttaaactggtgcagttgcccaagagtgccatggataccttcaagtcggtttctaaatatggaatgctgctgctgcggtgcgacgatagggtcgacaagaaattcgtatcgcagatccagaagaacgttgatctgcttcagtttccctggttaaatgctatcaagtatcggcccacatctgtcaagctgttgaaaactacagtgccaattgtctcgaagaagaggcaaaagtag

SEQ ID NO: 77 - DNA, 2352 bp, Saccharomyces cerevisiae
atggtgaatactaggggctacactactcttccgaatgttgaagaaccagcaaataactcacaagatgagctaaactcgcaggactttgagcaagctataggaatgccatcagaacccccggtatatgtggaagagatggggatggaagaaccgcaggctccggaagcctttagtgagaaagtccagcgatttcgtatgtgttttgaaaataacgtggtgattccagtaaagaaaaatgtagtggatccgctagcacaaatgatttccctggcctctgagaaattcgatttgttcttaagtaaaataggtaatgttatggtaatgaggagaatattttacatcatgatgatgtctatcattgcagcgttgattattgcgagtgataggttaccgaatggaaaagctcgaggttcaaatggatcattctcggaccatgatctccttttacagtatgctcggaaatcgatagacctttcaaagatagaaagagatttagagtatattagtagtatgccccacatgtcaggaacaagtggtgatgccgctattagacattatattaaagagtcgttcgacaaaaatggtataaggctagctggggaagaggagttcatggcgtattcgaattacccaggaaatgtctcacttcgtgtatattcaaaggatgatacagaagggtttgatattcccttaaatgaggagaactttaacccaatgagccataatggtcaattgaacaacataccggtgatttatgctaataaagcatcgttggacgatatggcttctatgcaagatcaagggcttttaaacggtgactttattttactagtgcattacggagattatgttttccaacaaatgttgactgctcaagaatatggtgcgaaagcaattatctttatttctgagccttatcaagacaacaaagacgtgatacaaatgaagtcagttgcgttgccgcagtatggtactggtgatgcacttacgcctgaatgggaaggatcaataagagatcctatcgatgctacggaagccaagtgcctacccaaaattccatccataccgatatctgccaatcaaggagataaaatactagctatattatcagacactggcgtaaagttttctaataatttattcagtgggtcgcttaacgattgtcgacttgacctactagtgcaaacagcaattagggaacgccacccggttcacgatatagttggtaaaattgaaggatcggaacaagcgggcagggcaattgttattgctgcaccgaggaactctgctagttatggcactatgtatccttcttttggaaccgtcgttttgctgtctctgatccaattatatcaagaaatggtttacaaatttgactggaagcctctaagaaatatatatttcatttcctttgggggctctgaatttaatgaagcgggagccacggagctgatggaaaagagaacagaggcattgaagagtgaaatatacaccattatcgacgtcggccaaatcggtatatgggatgatagtaacaatttagagatacaatgtcatccgctactagtagatctttttcaaaaaaacatgacaagccgtaaatttaacgttaaagtggataatgttcaccagttcggcgactggacgccgtatctagcgcaagggattccagttgcgatcatttcatctccaggagtcatgaatagagaacatccgatctacacagtagaagacaaattcgatttcatcaaagataaactaagagacaaaaagaagggagaggtactttctgagataatgctatatcttgtcgaaaaatcactcgagctcattgacgatccattcatcccattcagcatatcgaactacgtagatttcctttcaactacgttaaaagacctccaaaaagaatgtcctgatacggtaaactttgacgaagtctttttgggcacaacattgtgggaaaacactaaactgcagttcgaaaaatggaaaagcgaatggacagagcttatgtatggagccggtacatatatagaacccactatcattgccattaatcgttggtcatggaactacctactttccctaataggcgttacccaatgtttggaggaagggttaatggatagaaccttttacaagaacgttatcttcgggccaaaactctgggtcgacaaaggtgacccacttcgttcatggacgttccctgaaatcagggacactattgcaatcaaggactggagctctgtgcaggttcaagctaacacactcggcacaattttacaaaatacagcacgctattttcttgagaataaaaaccttcatggaataaacacgaacgaattttag

SEQ ID NO: 78 - DNA, 1617 bp, Saccharomyces cerevisiae
atgagttctgtcgcagaaaatataatacaacatgccactcataattctacgctacaccaattggctaaagaccagccctctgtaggcgtcactactgccttcagtatcctggatacacttaagtctatgtcatatttgaaaatatttgctactttaatctgtattcttttggtttgggaccaagttgcatatcaaatcaagaaaggttccatcgcaggtccaaagtttaagttctggcccatcatcggtccatttttggaatccttagatccaaagtttgaagaatataaggctaagtgggcatccggtccactttcatgtgtttctattttccataaatttgttgttatcgcatctactagagacttggcaagaaagatcttgcaatcttccaaattcgtcaaaccttgcgttgtcgatgttgctgtgaagatcttaagaccttgcaattgggtttttttggacggtaaagctcatactgattacagaaaatcattaaacggtcttttcactaaacaagctttggctcaatacttaccttcattggaacaaatcatggataagtacatggataagtttgttcgtttatctaaggagaataactacgagccccaggtctttttccatgaaatgagagaaattctttgcgccttatcattgaactctttctgtggtaactatattaccgaagatcaagtcagaaagattgctgatgattactatttggttacagcagcattggaattagtcaacttcccaattattatcccttacactaaaacatggtatggtaagaaaactgcagacatggccatgaagattttcgaaaactgtgctcaaatggctaaggatcatattgctgcaggtggtaagccagtttgtgttatggatgcttggtgtaagttgatgcacgatgcaaagaatagtaacgatgatgattctagaatctaccacagagagtttactaacaaggaaatctccgaagctgttttcactttcttatttgcttctcaagatgcctcttcttctttagcttgttggttgttccaaattgttgctgaccgtccagatgtcttagctaagatcagagaagaacaattggctgttcgtaacaatgacatgtctaccgaattgaacttggatttgattgagaaaatgaagtacaccaatatggtcataaaagaaactttgcgttacagacctcctgtcttgatggttccatatgttgttaagaagaatttcccagtttcccctaactataccgcaccaaagggcgctatgttaattccaaccttatacccagctttacatgatcctgaagtttacgaaaatcctgatgagttcatccctgaaagatgggtagaaggctctaaggctagtgaagcaaagaagaattggttggtttttggttgtggtccacacgtttgcttaggtcaaacatatgtcatgattaccttcgccgctttgttgggtaaatttgcactatatactgatttccatcatacagtgactccattaagtgaaaaaatcaaggttttcgctacaattttcccaaaagatgatttgttactgactttcaaaaagagagacccaattactggagaagtcttcgaataa

SEQ ID NO: 79 - DNA, 1752 bp, Saccharomyces cerevisiae
atggtgcgttttgtttcaattttaagtttattcggctgcgcggcgacgcttgtcacggcccatgatgacatggacatggacatggatatggacatggatatggacatgaatatcgatacgacaacgtctcaatccatagatgtctcatccacggcttcaatcgtccccgtgccacatgaaccaaaacatttgcatggccttcctatactgcaatcgccctcgcttacccctgcggagagattgtactgggaaaactacaacaccacaacctactttactacacaggctgggaataggtctgcccttcgctaccacattattacgctgctcttggttgcatttgtgctctaccctgtgtccctggcgctaagcgccgcccgttctaggtggtacttacccctgctgtttgttaatctatgcatttgtatttcgtccgtaatggcattgtccgtgttcaaaaatactttcccggaagaagactggtatgcgcataatatctatggcaccacttctgtgctacttctcgtttttatgcttgttcacttcttcgctgcggtgctttctgtccccgtctcattagcatcgaaaaaggagtaccgtccggttgacaccatccctctgaatgatcttgaatctacgcccgtcatggtgaatagtgcacgtggctctccaagtccttcttccaacagagacacgttgttctcgctctcttcagacaccacgaccgccacggccaccaataataataaacggagacgcgctgaaggcgaagacgagggtgataacacctccaaccacgacactttgcgcgacgaagactacgataatgatgacgacgaaattgcttccattgaagcgccacctctgcttcctcaagacatacccgttttccgaatcttgtttaccaacacgaagtaccagatgcttgccgcgcacctctcgtgcgtcgccaacgtggtctttcacatgcttacctacccgctattcatgtacatctttgtagacctaatcatcggcttcgctgtaggtaacttgctcggcaagggcatccgcatctttaatctcttggcccactggattaagggcggcgtattttttactctgggcgttgtctctttagcaagatactgcggtttcgcagctaagtacggctgggcatggaacaacatcagcttcacctctcaactcacacaaacgcgttcctccaatcttcttttccggtttgctcctgcggggactttcaccatggaattcgttgaatccttcctcattttcttttacgggtccaccaacatcttcttggagcacctggcaggaaacggcggcgcatggactgccaaggatttacagcatgtgtcgataaattctcaccggccccaaggtgtgtgggctactcacggagtacaagctcaaccattggcgattcgagcatgcccgcaaacggccacagaccgatgtagttgctgccacaccggggtactctccaaacccgttccccgctttcaccatattttggactgggattctgatgtcccagcacgcacagtcctcgcaattttctactaccattcacacgcaatggggatacttgttgtcctatgggtccttcttccgtctgctaacatttttgattctgtttttggtgcccaacaccaacagtgccgcatccaagcctttcacggagttgatcacctcgttctgtctcctctgtggtggtctggtatttatggagtccacggatcagtccattga

SEQ ID NO: 80 - DNA, 5607 bp, Saccharomyces cerevisiae
atgtccatttcttctgacgaagcgaaagaaaaacagctcgtggagaaggcagaattgcgcctggctatcgcagattcccctcaaaagttcgaaactaatctgcagacttttttgcctccattattactaaaactcgcctctccacatgcctccgttagaacagcagtattttcagccttaaaaaacctcatttctaggataaatacgctgccccaggttcagcttcctgtgagggcgcttattgtccaagcaaaggaacccaatttagccgctcaacaagactcgaccaatgtccgcctttacagtctgctactggcgtctaaaggcatagataggctttccttgcaagatagacagcagttgctaccgttagtcgtttcgaacatctcgtgtctaacaggcacagtagccgccagaatgttccacatccttttgaagcttattttggaatgggttgcaccccaggagtcttcacatgagcaggaagaatttgttcagttccttcaactggacaacgacggtttttcgtttttgatgcgccaatttaccaggttttttctgctggtaccttcaaagcaagtccaggtttctcaacagcccctgtcgagaggttacacatgtccgggcctatctctaactgatgtggcattctttacttatgatgcgggcgttactttcaacaaagaacagctgaataagttcaaaaaggctatttttcaatttgtttgccgtggcatggcggctacccaaactattgagcagtcacctaggatgattgaactgatggaatttttgtgcgttgtctctacggattctacaaatttatctgatgatgcggctcagttcatgaaacggtttcccatgccttatgaaaacgaagagttcatcacctttcttcagacgctgtacatcggcaacacagcaaatggaagaccgccggtcaaggctatcttgcaagaaaaaatcctgtccatattaaacagaagtcacttcgccaccaccaaagcagaatgtatttcgttgatttgctctattggattgcattcatctgagtataaacttagatctttgactctttcttttattcgacacgtagcaaaattaaattacaaaaatttaaatcctgcttcttcatcaccttcatcaacagacttttccacttgtattgtttccttgattagaaataatcttcatgccgaaggttggccgaagttacaattggggcctcagaccccagctttcaatacagccattctgcagagacagctgcaatatgaaacattgggtgatatcttgaaaagagattttgagcttgtaagtgacttatcctatattgaatttctattcgagtccttgaaaaatgacttaccacagttccgctccagtattcaggagtctctgctttctctagtaggccatttatcaattctaccccaacaatctaaattaaaattaaaaaatttgctcaggaaaaacctgtcaattgacgagcaacagcgggaggataataatgatgctgttaattctataatggcactcaaatttgtatctataaaattcactaacgctgccttccccttccatgatcctgaggcaaggttattcaatatttggggtactgtacgaacgaatagatttgacattattgaagaatcctttaaggggcttcaacccttttggttcagggttaataatgcttccataaatacatcagctaccgtgaaaacatccgatctgttgggctctcacttgtcagagactgaatttcctccattccgggaatttcttcaggttttgatcgaccagctagattcggaagctgcatcaattacacgaaaatcactgaacaacgctgtcagatttagtaaacaatgtctcatttccaatgcaatatacggtaaaaaaacaatggttatacaagatgaggattggtcagttagaatagacaaagctttggaacttgacgacacagttgtgtcccgagttaatgaaatggttcaaggcatgaatgatgatattttcattcgctatttgactcttctgtcaaacgagtttacagctacgaacagtaagggtgaacaaattgcaatatttccatatcaagatccaatttttggttctgtcttattaactttattgaattttgtgagcaataatgttttacggagattggaaattcttgttcccgatttataccatctagttatcatgaaatttcaatcgttgagtgataatgatcttgcagtctgtgcaaccatcatcggtataatttctactgctatcgcagactcgactcacgttaagcgaatcacaaaaatagcacaatcacaaacaatggcagagacatatgttgcatcttatgttgttccacgattatatttgaaagatcaaacaaatcacattgaatctgacagtatcctaaacctattaaacattttaacaactcatctatcgcatcctggcactaacaaggatatgatattaaagttggtctgccaagtgacaaaattcggtttacttctccaagtaagtgcacaagaaaggaaagatttcttgaaaaaagtcatggatactatacaagacaaattgatcaacgatgtgacagcaattcaaacgtggtcatacctatcactatattcaacagatttagagaattccagtctttttcaagaaaaattacttgaaactaacgtttctaagcaaaacgatttcttattttcagttggtgaatctttaagtgttgtggctggtaaatggtcaagtaagtacttgatcaaacagattgatattcctaatttcaatgttgagatcatgcaacaaaaattccctgctacaaatgttaccactatacttgatgagatcttttcaggttgcgactctacaaaaccctctctgaggaaggcatcttgtatttggctgttatcatatattcagtacttaggtcatttgccagaagtaagttccaaatgtaatgatattcacttgagatttatgagatttttggcagacagagatgaatttatacaggattccgccgctagagggctttctttggtttacgaaattggtggttctgatttaaaagaaagtatggtcaaagggctacttaaatcatttacagaatcaaccgcagggtctgcatctacaagtgctactggcatctcaggttcagtctccgaagagaccgagttatttgagccaggagttttaaacactggagatgggtccattagcacttacaaagatattttgaatttggcatctgaagttggggaccccgcacttgtttacaaatttatgtctcttgccaaaagttctgcgctatggtcatctaggaaaggtatcgcattcggtcttggcgccattatgtctaaatcttctttagaagaattattactaaaggatcagcaaactgccaagaaattaattccaaaattgtatagatacagatttgatccatttcaagcagtatcacgctcgatgacagacatctggaatactttaattccagaatcctctttgacgatttccctctatttcaatgatattcttgatgagcttttatgtggcatggctaataaagaatggagggtcagggaggccagtacttcagctttattacaattgattcaatctcaaccgcaagagaaattttccgaaaaaatgctgaaaatttggacaatggcattcagaacgatggatgatataaaagatagtgtccgtgaagttggtaccaagttcaccactgtattggccaaaattttggcaagatctattgatgtggaaaaaggtgtgaaccctaccaagtctaaggaaatactagacaatattttgccatttttatggggtccacatggtctgaacagtgatgcagaagaggttagaaattttgcgctcacaactttgattgacttggtgaaacactcccctggagccatcaaaccgttcactccaaaattaatttacgattttatcacattgttttcttccattgaacctcaggtgattaactatttggcattaaatgctgcaaattataacattgatgctaacgtcattgatacgcaaaggaaaaatggtgtcacaaattcacctctattccagaccatcgaaaaattaattaacaattcagatgattgtatgatggaagaaataattaatgtggttattaaagctagcagaaaatcagtcggattgccatctaaggtcgcatcctcacttgtcataattatcttagtgaaacggtactctatcgaaatgaaaccctattctggaaagttgttgaaagtctgcttgactatgtttgaagatagaaatgagtcggttaatatagcatttgcaatttcaatgggatatttattcaaggtttcagcgttggataagtgtattaaatactctgaaaaactaataacgaaatattttgagcctacctcaacagaaaataacaagaaagttgttggtacagcgatcgactcgattttgaattatgcgaagtcagaattcgataatgtggcaagtgtatttatgcctttgattttcatagcatgcaatgatgaagataaagatttggaaaccttatataataaaatctggacggaagcttccagctctggcgccggtacggttaaattatacctgccagaaattttaaacgtactttgtgtgaatataaagtcaaatgatttctctattcgaaaaacatgtgctaaatcagtcatacagttgtgtggcggtattaatgatagtattccttatccacaaattgttaagttatttgatatatcgagggaggcattaagtggtagatcatgggatggtaaagagcatatagtggcagcattggtttcattaacagaaaaattttctcaaactgtggccgacaataatgatctacaagaatcaattaatcatgtaatgtacactgaagtttcgagaaaaagtatgaaatatgttaagaagatactaccgctttacgcgagatatatcaatgtgaatccacaagaagagacgatcaccttcttaattgaaaaagccaaagaaatgattcgattgttgggcagcgaatctgatgatagtgaaggttccattaagcagacttccgatgaatccacaataaaaagaattaagcctaacactgaaattacacaaaagtcatccaaagagaacattgagaacgaagagtatgtgatcaacttgttaaaagttagtgttgacatatgcaacaattctaaatcgaggtatccgatgaatttattggagttcattatagatgagattgcataccttttccataatgacagaattatacacacatggagaacgcaactagctgctagtgaaattggtatctcgatagttggaagatttagtaccataagtagcgctgactttatccaaaatgtggggagactatgggatcaaacttttccaataaattgtaacaaggaaaccattgagaatgtgaaattgcagatgataaagttcggtggcctgatcattcagaagattccaagcttgcagaacaatatcgaggaaaacttacggttgttgaacagtattgattcaacgagcagaattgagttggaattgaaaaatattggtctatga

SEQ ID NO: 81 - DNA, 2844 bp, Saccharomyces cerevisiae
atgtcttccactgaagcaaagcaatacaaggagaaaccctcgaaagagtacctccatgccagtgatggcgatgaccctgcaaataattctgccgcttcttcgtcatcttcgtcttctacatcaacttccgcctcgtcatcggctgcagccgttccacggaaggccgcagccgcttctgccgctgatgattctgactcagatgaagatatagaccaattgattgatgaactacaatctaactacggtgagggtgatgaatctggtgaagaagaagtacgtactgatggggtgcacgctggccaaagggttgttcctgaaaaggacctttctacggaccctgcgtatggtttgacttcggatgaagtcgccaggagaagaaagaaatatgggttaaatcaaatggctgaggagaatgaatcgttgattgtgaagtttttgatgttcttcgtagggcctattcaattcgttatggaggctgctgctattttggctgccggtttgtctgattgggttgatgtcggtgtcatctgtgctttactgctattaaacgcatctgtcggatttattcaagaattccaggcaggttccatcgtagacgagctgaaaaagacgttggccaatactgcaacagttattagagatggccaattgatcgaaattccggctaatgaggtagttcctggtgagattttgcaattggaaagtggcacaattgctcccgcagatggtcgtattgtcactgaagactgttttttgcagatcgatcaatcggccatcactggtgaatccttagccgctgaaaagcattacggtgatgaggtgttctcctcatccactgtgaaaaccggcgaggcttttatggttgttactgccactggtgacaataccttcgtcggtagggctgccgccttagtggggcaggcttccggtgtagagggccatttcactgaagtattgaatggaattggtattatcttacttgttctagttatcgctactttgttgttggtctggaccgcatgtttctatagaacggtcggtattgtaagcattttgagatatactttgggtataaccatcattggtgtcccagtcggtttgccagcagttgttaccacgaccatggctgtcggtgcagcttacttggctaagaagcaagccattgttcaaaagttatctgctattgaatcccttgctggtgttgagattttatgttctgacaagactggtactttaaccaaaaacaagttatctttacacgaaccctacactgtcgaaggcgtttctccggacgacttgatgttgaccgcttgtttagctgcctctagaaagaagaaaggtttggatgctattgataaggcttttttgaagtcattgattgagtatccaaaagctaaagacgccctgaccaagtacaaagttttggaattccatccgttcgaccctgtctcaaaaaaggttaccgctgttgtagaatccccagaaggtgaaagaattgtttgtgtcaagggagccccattgtttgtcttgaagactgttgaagaagatcacccaattccggaagatgtgcatgaaaactacgaaaataaggttgctgaactagcttctagaggtttccgtgctttaggtgttgctagaaagagaggggaaggtcactgggaaatcttgggtgttatgccatgtatggacccccctagagatgacaccgctcaaacaatcaatgaggccagaaaccttggtttgagaatcaagatgttaaccggtgacgctgttggtatcgcgaaagaaacgtgtaggcaattaggacttggtacaaacatttataacgcagaaaggttaggtctgggaggtggaggtgatatgcctggttcagagttggctgattttgttgaaaatgccgatggtttcgcagaagttttcccacagcataaatacagagtcgttgaaatcttgcaaaacagaggttacttggttgctatgactggtgatggtgttaacgatgccccatctttgaagaaggctgatactggtattgctgtcgaaggtgctaccgatgctgccagatcagccgctgatattgttttcttggcccctggtctctctgctattattgatgccttaaagacttctagacagattttccacagaatgtactcctatgttgtttatcgtattgccctatccttacatttggagattttcctgggtttatggattgctattttaaacaactctttggatatcaatttgatcgtttttattgctattttcgcagacgttgccactttaactattgcttatgacaatgctccttatgctcctgaacctgtgaaatggaacctaccaagattatggggtatgtctattattttgggcatagttttagctataggttcttggattactttaaccaccatgttcttgcctaatggtggtattatccaaaattttggtgccatgaatggtgtcatgttcctgcagatttcactaactgaaaattggttaatttttgtcactagagctgctggcccattctggtcttccattccatcgtggcagttagccggtgccgttttcgccgttgatattattgctaccatgtttaccttatttggctggtggtctgaaaactggactgatattgtgtcagtcgttcgtgtctggatttggtccattggtattttttgtgtattgggaggattttactatattatgtccacgtctcaagcctttgataggttgatgaatggtaagtcattaaaggaaaagaagtctacaagaagtgtcgaagatttcatggctgctatgcaaagagtttctactcaacacgaaaaaagcagttag

SEQ ID NO: 82 - DNA, 1062 bp, Saccharomyces cerevisiae
atggtcgatacgcataaactagcagacgacgttcttcagctattggataaccgtatcgaagataattatagggtttgtgttatcctagtcggttctccaggctccggtaagtctactattgcggaagaactttgtcaaattataaatgaaaaatatcacacatttttgtcagagcatccaaatgttattgaggttaatgataggttgaaacctatggttaacctagtagactctttaaagacgctccagcccaataaagtagctgaaatgattgaaaatcaggggctgtttaaagatcatgttgaggatgttaattttcaaccagtcaagtactcagcccttacatcaaataatgaagaatgtaccgcagtagttgccagaggtggtactgcgaatgccataagaatcgcagcagttgataatccagtcaatgttaacaagttggcccaggatagtatcaatatagcgcaaatagtcccaatggatggttttcacttatctcgcagatgtctagacctattcaaagacccacaaactgcccataaaagaagaggttcgccctcaacgtttgacagtaacaatttcttacaattgtgtaaaattctagccaagacgtccctatgtaaggtctcctcacatcataaattttactccacttcaagcgtttttgagaagttatccaaaacttttagccaaacaattcctgatatctttgttccaggatttaaccatgcactaaaagacccaactccagatcagtactgtatttccaaatttacaaggatagttatacttgaagggttatacctactgtatgaccaagaaaactggaagaaaatttacaaaacattagctgatacgggagcacttcttgtttataagattgacatagactatgaggccaccgaagaaagggtggccaaaaggcatttgcaatcagggttagtcacgactattgcagaaggacgagagaagtttcgcagcaatgatttgttgaatggcagggatatagataatcatttaattaaggtagataatatcgtccatatccgcaacgactag

SEQ ID NO: 83 - DNA, 534 bp, Saccharomyces cerevisiae
atgagcagcattccagctggcactgatcctgggtcctgcggtgctaatttcaagaatgaccgcaagcgcagagataagatcaacgaccgtattcaagaactattgagtatcattcccaaagacttctttagagattattacggcaattctggtagcaatgacacgttaagtgaatccactcccggtgcgcttgggttgtccagcaaggccaaaggtacagggaccaaggacggaaagcccaacaagggccaaattctcacacaggcggtagagtacatatcacatctacaaaatcaagtggacacacagaacagagaggaggtggaactgatggtgaaggccactcagttggccaagcagacaggcaccattgtcaacgatataaacttagagaacaccagcgctgaagtcgccctgtccaggattggcgtgggaccgctggccgcaacaaatgatgactcagtaagaccgccagcaaagaggttgagctccttcgagtacggagggtatggtgagtacggtaatggtagctaa

SEQ ID NO: 84 - DNA, 411 bp, Saccharomyces cerevisiae
atgacatatcttagaatagcgttagcatcaaacaaaaggaaaggttcctttgtattgcgcaattccatggcagcattatcattgtcaacttcaggctttaaatttttgcttgcatattcaagtgctagggcaatcttcaaattgttcgctaactgcaaatgggcaggatgtttcttcgatttatcaaaggaaatgaggaaagacatgcttgttgtaaatttccgcttttttttcaagttttattcctccacaaagatgcatatcaggaagcaaatcatcattaacattagacatcgaagaaaatttgtcatcgtctttttttttttttcgttttctctttcgataagttgcgtacagaaattttttctgcctccgaaatcattcgtgcctcgtgatattgagaagaagtga

SEQ ID NO: 85 - DNA, 462 bp, Saccharomyces cerevisiae
atggcggcaacaccagcagcgattgaagttagtttgaccattgtatttgttttgttttttagtgctgatgtaagcttaacaagaaatagtgaaatgaaagcgcatacctcaaagatggatagctacagcagctctatttatatgaatgtcttgccaacttccctggcacaaacgagttatcatctggcacccatctctcacctaaaatgcctcagtgtacaatgttcatcccacattcattattcatattattacggtgcttctgtacttgaacgatgcgtctttcataggtcccgtatacgaggcgcacgcttcatagtgcctatacctttttattgcatttccaaggcacaagaatgttttctcacagtgtacatacttccgaagaatccctttagggtgccttcagagatgcagctgcagcttttggccaagaaaaagctaaaaccaaatttgctttga

SEQ ID NO: 86 - DNA, 1995 bp, Saccharomyces cerevisiae
atgaagttgcagagtttgttggtttctgctgcagttttgacttctctaacagagaacgttaacgcttggtcaccaaataacagttacgtccctgcgaacgtaacctgtgatgatgatattaacttagtcagagaagcatctggtttgtcagataacgaaacagaatggctgaaaaaaagagatgcatacaccaaggaggctttgcattcttttttgaatagggccacttcgaatttcagtgacacttccttgctatccactctttttggtagcaactcttccaatatgcctaagattgccgtcgcctgttctggtggtggttaccgtgccatgttgtctggtgctggtatgcttgctgctatggacaatcgtactgatggcgcaaatgagcatggtcttggtgggctgctgcaaggtgcaacttacttggcaggtctgtcgggtggtaactggttaacaagtactttggcttggaacaactggacgtctgtgcaagctatcgtggataatacaacagaatctaactcaatttgggacatctctcattcaattcttaccccagacggcattaacatctttaagactgggagtagatgggacgacatatcagatgacgttcaggataaaaaagacgccggtttcaacatctctttggcggatgtttggggccgtgctcttgcgtacaatttttggccaagcttacaccgtggtggtgtagggtacacatggtcaactttaagggaagctgatgtcttcaagaatggagaaatgcccttccctatcactgttgcagacggtagatacccaggtaccaccgtgataaacttgaatgccactcttttcgaatttaatccctttgaaatgggttcatgggaccccactttgaacgcatttacggatgtgaagtatttaggtaccaacgttacaaacggtaaaccagttaataaaggccaatgcattgccgggtttgataacactggtttcataacagccacttcatctacgttgtttaaccaatttttactaagattgaattctaccgatttaccttcatttattgctaacttagccaccgatttcctggaagatttatccgacaatagtgacgatattgcaatttacgccccaaatccattcaaggaagctaattttcttcaaaagaacgcaacctccagtattatcgaatcagaatatctatttttggttgatggtggtgaagataaccaaaatattcctttagttccattgttgcaaaaggaacgtgaactagatgttatttttgcattagacaattctgctgatactgacgactattggccagatggtgcttcattagttaacacttatcagcgtcaatttggcagccaaggtctcaatttgtctttcccatatgttccagatgtgaacacatttgtcaacttggggttgaacaaaaagccaaccttttttggttgtgatgcaagaaatttgacagacttggagtacattccaccattaattgtttacattccaaattcaagacattcatttaatggtaaccaaagtacttttaagatgtcatactccgattcagaacgtcttggtatgattaagaatgggtttgaagctgccacaatgggtaattttactgatgattctgatttcttgggctgtgttggttgcgccattatcagacgtaagcaacaaaacttgaatgctacattgccctctgaatgcagccagtgttttaccaactactgctggaacggtactattgacagcaggtcagtctcaggtgtaggaaatgatgattattcttcttctgcttccttgtctgcctccgccgctgctgcctctgcctctgcctctgcctctgcttccgcctctgcctctgcttctgggtcttccactcataagaaaaatgcgggcaatgctttggtgaattattctaacttaaacactaacacttttattggtgtcttaagtgtcattagtgccgtcttcggtctaatttag

SEQ ID NO: 87 - DNA, 2301 bp, Saccharomyces cerevisiae
atgagtgaagaggaaacggtctcagccccagctccagcttctacaccggccccggctggaaccgatgtaggtagtggtggagcagcagctggaatagctaatgctggtgctgaaggcggcgacggtgccgaggatgttaagaaacatgggtcgaagatgctagtggggcccaggccgccacaaaatgcgatattcatccataagctataccagattctggaggacgaatcgctacacgacttgatatggtggaccccttcgggcttatccttcatgattaagcctgtggaacggtttagtaaggctttggctacatatttcaagcatactaatatcacgagctttgtaagacagttgaacatttacggctttcacaaggtgtcgcatgatcatagcagcaacgacgctaatagtggcgacgacgccaatactaatgatgacagcaatactcacgatgataatagtggcaacaaaaacagtagtggcgacgaaaataccggtggcggtgtccaagaaaaggagaaaagtaaccccactaaaatctgggaatttaagcatagttctggtattttcaagaaaggtgacattgagggactcaaacacattaagagaagagcttcttcccgtaataactcctcaattaacagtcgaaagaattctagtaatcaaaactacgatatagattccggtgcaagagtaagaccctcttcgattcaagacccgtccaccagttccaattcctttggtaatttcgttccgcaaattccgggcgccaataactctatccccgagtactttaataactctcatgtaacttacgaaaacgcaaaccatgccccgctggaatccaataacccggaaatgcaagagcaaaacagacctccgaactttcaagatgaaacactgaaacatttgaaagaaataaattttgatatggttaagattatagagtctatgcagcatttcatatctttgcaacacagtttttgttcacagagtttcaccttcaagaatgtgagcaagaaaaaatcggaaaatatcgtgaaggatcaccaaaagcaacttcaggcattcgaaagcgatatgttaactttcaaacagcacgtcatgtcgagggcccaccgtacaatagattctctttgtgctgtaaatgctgccgctaccgctgcctctgtcgcccctgcacccgcgcccacatccacatctgcatatgcacccaaatctcagtatgagatgatggttcctccagggaaccagtatgtcccgcagaaatcttcctcgaccacgaacatcccttcgagattcaacacggcttcagtgccgccctcgcaacttttgtacaataccaaccgcagtcgcaaccaacatgtgacttatgcgagcgaaccggcacatgtaccaaactttatcaatcagccgatacccatccaacaactacctccacaatatgcagacacttttagcactccacaaatgatgcacaatccttttgcctcgaaaaataacaacaaaccgggcaacacgaagaggaccaatagtgttctcatggacccgctgactcccgcagcgagtgttggagttcagggtccactaaactatcctatcatgaatattaatccttctgtccgtgactacaacaagcctgtccctcaaaatatggctccgagtccaatatatcctattaatgaaccaacaacgagattgtattctcaaccaaaaatgagaagtctcgggtctacaagctctttgcccaacgatagaagaaacagtcctctgaagctgacaccgagatcatcgttgaatgaagatagtctgtatcccaaacctagaaactctctcaaatccagtatttcgggcacgtctttatcctcctcttttacactagttgccaacaatccagccccaattcggtactctcagcagggattgcttcgctcattaaacaaagctgctaattgtgctccagattcggtaactccattagactcgtctgtcttgacgggccctcctccaaaaaacatggacaatcttcctgctgtttcttcaaatttaataaactcccccatgaacgtcgagcacagctcaagcctatcacaagcagaacctgcaccacaaatagaactaccgcagccatctttgcccacaacgagcaccactaagaatactggcgaggctgacaatagtaagagaaaagggagcggtgtttattctttactgaatcaagaggatagcagcacgtccagtgctgatcctaaaactgaagataaggccgctccggcactcaaaaaggttaagatgtga

SEQ ID NO: 88 - DNA, 1971 bp, Saccharomyces cerevisiae
atgaatagtgacttggagtatttagaggacggttttgatccgaattcaatgaaagttgcgactttgaggaggatattggtagaaaataatgtcgatttcccatctaatgctaggaaaaatgcgctggtggggctgttcgatgaaaaggttaaaccgcagatcccgcagttacggaaaatgtatctgaacgttcggcccagcgatgaaggtattgtgaaaatggaccgtccctcatcttccccatctatagcttcccctcgtagaagtagacgagctcgcagggagaaatctgcttcccccatggccaaacagtttaagaagaatagaatactggatgatgtaagtaatgatgatgatgatgatgatgatgatgatgatgacaatgataaaaaagacgatcctttaattgtacctagtggaacggataccgatgaagtggacgatgaagaggatgatgtgataacatcaagctccaacaaatcagacaccaatgatttccagcaaaattccgatactcgtaagaaaaggaaagaccctgattctgacgactggtctgaatctaattcaaaggaaaataaaatcgataataagcatttgaacctcctatcatcagattcagaaattgaacaggattaccagaaggcaaaaaagcgtaagacgagtgatttgaaccaagagcatggaaatggctctgccattttaggaaaactttccgtcaaaacaccaataaagaacacaaatagaaagccagtaagcatggataattttaacgattcgttgacttcaagcggtacggaaaatgatccatttgtaccgaacatacgacacaatccaaaagagctcggaactgccaatggaacaggccatagcacacccttgagtaagttaaaagtttctgcctcatttgcggataaattgcctcaaaaggaggtaccatctacaatactggttccagaagtggaacagcaagaaccttctcagagtgaaagaacaccgtctttgttttcgtccgaaggctctggctcagagtcggaagcacccttgcttccagagatcaccacgccaggtcctcatcagcctatgggtaataccagcaataatgtggtcgaaatgatagatacagatagtagtaacttggtatcggatgaagatgaagttttagtgcctacaaggatcgagactccccaattacccacagagaaagacgtcgaaaagtgtgaagcaagagtgcaagaacttcaagaggaagtaaatgagcaattagagcatgaaaatgggagtgaatttgatgttaagcaaggatctgggaaggtcgggaacaggcataagttcaaaagagcactcaaatttttgagcaaatcattactggcgctatttttattttgcatattcattgttattcctctcttatttggcctctggtatagagagcaaagactgctcataggttactgtgggcatgaagtaccatcccatcgagttagtggcaattccttcgagtttattcaaaaactggataatttgttgcaggactacagaccgaaatgtatcccttgtccacccaatggtatttgttatccttatttgaaacttaaatgtaagccagattacaagttagcaccatctagacttgactttttggaaattattcctgcacaaggcaaatgtgttaaagacgacaaaaaacagcagttagtttccgaagtggttgaaaaatctttagagtttctgagagccaaaaatgcacaaatttcatgcggtgacggaaaagacgacatcgagagtggtatgacggaagatgccctctatcaaatatttaatgaggctagagctccttggattcgcgacgatgaatttgaggacctgtggatccaagttatcaaagatttaactgaagaaccagaaatattatggaggcaagtgagtacaatttattatcttacaaaaattattaaacctgttattatatga

SEQ ID NO: 89 - DNA, 348 bp, Saccharomyces cerevisiae
atgcatcgactacgagcgtattgtgttatatcagctctgtccgatacactgcttgccttttgtacgagctcggccgagctatacgaaggcccgctacggcagtatcgcattaaagcgacgcaaattcgccgatggtttggtagaagagcttgcagaacgattcccattcgccacgatcccgtagagtgccctgaaccacgctcatgtccatgttcataccattcacgtttgtggagcaaacgtttaggccgaacgcaaatctcaaggcgcctgcagactgcgagaagattaaatcccgaacgtagtacggcttggtcgtatcttgcgagacaagtcctgtattactga

SEQ ID NO: 90 - DNA, 2274 bp, Saccharomyces cerevisiae
atgatgcgtggtttcaagcaaagattaataaagaagaccaccgggtcttcttcttcttcaagcagtaaaaagaaggacaaagagaaggaaaaagaaaaaagttccactacctcatccacatcaaagaagcccgcttcggctagtagctcttcccacgggactactcacagttctgccagcagtaccggatcaaagtctacaactgagaagggcaagcaatctggtagtgttccctcgcaagggaagcatcatagtagctctacatcaaaaacaaaaacagcgacgaccccttcttccagcagcagtagcagtagaagttcaagtgtcagtcgctccggttcaagctccacaaagaaaacaagttcaagaaaaggacaagaacagtccaaacaatcgcaacagccatcacaatctcaaaagcaaggatcttcttcatcatctgccgctataatgaaccccactccagtactcactgttactaaggacgacaaaagcacttctggtgaagatcatgcacatcctactttgctgggggcagtatccgctgttccatcatctcccatttcaaatgcttcaggtacagcagtttcttctgatgtagaaaatggtaatagtaataataacaatatgaatattaatactagtaatactcaggatgcaaaccacgcctcctcacaaagtatcgacattccgagatcatcacactcatttgagagactaccaacacccacaaaacttaaccctgacacagatttagagttaattaagactccccaacgtcattcttcatctagattcgagccatctagatatacgccattaacgaaattgccaaattttaatgaagtttctcctgaagaaagaatccctttgttcattgccaaagttgaccagtgtaacactatgtttgactttaatgatccaagttttgacattcaaggtaaagagattaaaagaagcaccttagatgagctaatagaattccttgtaacaaataggttcacttacacgaatgagatgtacgctcatgtggtgaacatgttcaaaatcaatctgtttagacctattccaccaccagtaaatccagttggtgacatttatgacccagatgaagatgaacctgttaacgaactagcctggcctcatatgcaagctgtttacgaattctttttaaggtttgtggaaagtcctgatttcaatcatcagattgctaaacaatatattgatcaggactttattttaaagttactggaattatttgatagcgaagatatcagagaaagagactgtttgaaaacgacactgcatagaatatatgggaagttcttatcattaagaagctttattcgtcggtcgatgaataatatttttttgcaatttatttatgagactgagaagtttaacggtgtggcagaattgttagaaattttgggttccataattaatggatttgcacttccattaaaggaagagcacaaggttttcttggtgaggatattgataccattacacaaggtccgttgtttatcattataccaccctcagttggcttactgtatcgttcaatttctcgaaaaagatcctttattaaccgaagaggtagttatgggcttactgcgttattggccaaaaataaattccacaaaagagataatgtttctaaatgaaatcgaggatatttttgaagtgatcgaaccgctggaatttattaaagtagaagttccgttatttgttcaattagctaagtgtatttcttctccacatttccaagtggcggaaaaggttttaagttattggaataatgaatatttcttaaacttatgtatcgaaaatgccgaagtcatcctacccattatatttcctgcattatatgaattaacttctcagttagagctagatacagcaaatggcgaagatagcatttcagacccttacatgcttgttgagcaagcaatcaattctggttcgtggaatagggcaattcatgctatggcattcaaggcattgaaaatttttctggaaacaaacccagtattgtacgaaaactgtaatgcattgtacttatcaagtgtaaaagaaactcaacagcgtaaggtgcaacgtgaagaaaattggagcaaacttgaagaatatgtaaaaaatctaaggattaacaatgataaggaccaatacacaatcaaaaacccagaattaagaaacagtttcaacacagcaagtgagaataacacattaaatgaagagaacgaaaatgattgtgacagcgagatacagtga

SEQ ID NO: 91 - DNA, 3423 bp, Saccharomyces cerevisiae
atgggttcatctggttcaaaatcgaccacagccactaccacatcgcatagtagcacgactactactagtagcacaaccagtacaactacgcctactaccactagcacgacaagcacgacaagcactaaagttacaactagcccagaaattattgtcagtagttctagcacattagtttcttctgttgtacccgagtttacttctagctcgtcgctctcctctgatacaattgcctcaattctatcatcggagtcattggtttccattttttcttctctttcttacacatcatccgatatttctagtacatcagtcaacgatgtcgaatcatcaacctctggcccctcaaactcatacagtgcgctttcctccacaaatgcacaactgtccagctccactacagagactgactccataagtagtagtgctattcaaacatcttccccgcaaaccagttcatcaaatggaggtggttcctcttcggagccattgggaaagtcctctgtccttgaaactactgcttcatcttctgatacaactgcagtcacatcctccacatttaccacgcttactgacgtttcatcttctccaaagataagttcctcaggatcggctgtcacttcagttggtactacttccgatgcctcaaaggaagtttttagttcaagcacgtccgatgtttcttccctactatcaagtacttccagccccgcaagctctactatttctgaaaccctaccattttcctctacaattttatccatcacttccagcccagtaagttcagaagctccatcggcaacgtctagctcagtgagttcggaagcttcatcgtcaacatctagctcagtgagttcggaagctccattggcaacgtctagcgtagtgagttcagaagctccatcgtcaacgtctagcgtagtgagttcagaagctccatcgtcaacatctagctcagtgagttccgaaatttcgtcaacaacatctagctcagtaagttcagaagctccattggcaacgtctagcgtagtgagttcagaagctccatcgtcaacatctagctcagtgagttccgaaatttcgtcaacaacatctagctcagtaagttcggaagctccattggcaacgtctagcgtagtgagttcagaagctccatcgtcaacatctagctcagtgagttcagaagctccatcgtcaacatctagctcagtgagttcagaagctccatcgtcaacgtctagctcagtgagttcggaaatttcgtcaacaaaatctagcgtaatgagttcagaagtttcatcggcaacgtctagcctagtgagttcggaagctccatcggcaatttccagcttagcaagttctagactgtttagctctaaaaatacatcagttacttctactttggttgctacagaagcttcgtcagtaacttctagcctaagaccttctagtgagacattagcaagcaattcaatcattgaaagctctttgtcgacgggttacaattcgaccgtttctaccacaacatccgccgcatctagtacacttggatctaaggtttcgtcaagtaattccagaatggccacttccaaaacctcatctacttcctccgacttgagtaagtctagtgtaatattcggcaatagttctaccgttacaacctctccatcagcgtctatcagtttaaccgcatctccacttccatcggtctggtctgatatcacctcttcggaagcttcatcaatttcctctaacctggctagctccagtgcgccatctgacaataattccaccattgcaagtgcctcgctgattgtcaccaaaacaaaaaactcagtcgtttcatcaattgtctctagtataacttcttctgaaactacaaacgaatccaatttggccacatctagtacatcgcttttgagtaataaagctactgcccgttctttatcaacatccaacgctacaagtgcttctaacgttccaacaggcacatttagctccatgagctctcatacttcggtgataactcccggcttttccaccagtagtgcgtcactcgcaattaattcaactgtcgttagctcatcattggcaggttatagtttctcgacacctgaaagctctccaactacttccactttggttacttcagaggctccttcaaccgtttccagtatgaccacaagtgccccatttataaataattctacctctgctagaccttcgccaagtacagctagtttcattactgaatccacttcaagcatttccagcgtgccattagcgagtggcgacgtcacttcctcattagcggcccacaatttaactactttcagtgctccttcaacatccagtgcacaacttgtaagcaaatcaactacctctagctccatcctggtcacacccagaatcgacaggtctggaaattcctcaactgcctctagaattgcaacatcactccctaacaaaactacatttgtttcttccctaagttcaacatccgctcatgccagaaatatctttaattcaactgttctagctactgctaaacaaattgaaactttaacttcaacagtcaattgcagcaaccctactcctaattacaacataaccaaaacagtaatcgtaagtagggagactactgccataggaactgttacaagttgttcgggtggttgcaccaagaatagaaagtcaaccacacttattactataacagatattgatgcttctactgttactacttgcccagaaaaagaagtaacatcgaccacaagtggagatgaggcagaacataccactagcactaaaataagtaatttcgaaacgtccacgttttcggaaagttttaaggatatgaagacttctcaggaaactaaaaaagctaaaccaggatcagaaacggtgaggagctcgtcatcttttgtcgaaaaaacctcaccaacaacaaaggcttctccatcaacttccccatcagaaagtaaagctgcaggaaatacatccgttgcaacgaatgcttcaccatcaacttccccatcagaaagtcaaggtacaggaagcacatctgtagagggagcaaaaagcaagtcaactaaaaattcagaaggagtatcaaccactaaagcgaaaaacacatcaactgttgcgaaatcttcaactgaaagtccgatcgggaggggtgaaactacccttgaaacgataattgtctcgagccaaaagtcgctattaacatcacaactaagttcatccactgaaaaggtaaacagatctaccaccaaacctacggcagcgattcatggaacatcctcatccgctaaacaaagcacaacatatactgtcagcacggcaaaagaaaataccggtgcatccctgaacattaacatgaaagcttttgttattggcgctattgctttggtagcttag

SEQ ID NO: 92 - DNA, 1308 bp, Saccharomyces cerevisiae
atgaaggaagagctcagcaaagtgagcagtatgcaaaatttcgagatgatccagcgtgaacgattgccaacattgtatgaagtgttaatacagaggacatcgcagccagttgatctctggactttttatacatttctttcacaattcccatatgccatcaactatctggacttttgggttgaccttatgacacatacacgactttgcaaaaactacatagagttggtaagaaaatcattaatcaactttccacaagaacaacagcagaatggaagtacatctacggctacatttgacttgctgaacgcactgatagaagaagggcacctagacccggaagcacctgataaactcttagaaaatagcggcccagacgtgcccttttcaccaaaattaaacgaattgctgggtgattggaagcaccaatcgggtatcggtcaagaagccctgagaaacgaagacgtagcgctgatcgtcgacgagataatgaaaaggcgctcccaacaagacggaaaaccgcagataactacaaaacaactgctgcacagcgcagttggtctctgcaacacctatttagtatcgcccgaacaaagcgaacggtacctgagcaacatccccatggaaacgcggaaccgcataatagaaagcgtacaaatcgagcgaaagtacgacattgagatttttgacgacctaaaaaacctaacttaccaattcctagaaatggattgtttcccaaaatttctaagccgcgtcgcactacacaacatccacgatgaaatatctgattggagattccactcagtgggcgtcaccaacgaaaaaagcaatcgctctcgaggccagacgcacatttctcgctcgccattctccaatcacacgtcaatcagtcgtattggctttggtttgctctggctaggcatcggcttttggatcggatatgttctaatcttcctggcgtatagtcgcgcaatccgtgtcgttacggtcgtgccatttacactgggatgctactgcattgtgtgtggcatgtatcaagtggacattgtgtattcctggtttggcgtcacacagagacttctccacagacacaaaaacgctggcaatgacgaaggagatgcttctagtgataccgatcacgtgccaatgatacttgcggtgttcggcggtaggcgccgtcttacccgcatagagcacccatttactcggcagcttctacgtaagcgtggactgtggtgtctgcttctcgtagtgggtgccactgccgcattcacagttattttcagctgtgttcccggccgtcgtgtatga

SEQ ID NO: 93 - DNA, 372 bp, Saccharomyces cerevisiae
atggtttggtctgaattgttggaaatactagcgtattctgtcgattgctccgttaatggagacttatacaccaacacgtcaggggaaatttcaacagcagacatacttaggttcgcggagattgtagaatacccttctgctacactattaacacagaatgtgcgtcaaaccacaccacacaataaacaatgcactttgctactaaaaccattctattcaccttgcgaaaacaacaagcgaaaaaaaaaaagcgagggcgaaagagtaagatcaccacgcacgtttaggggatcggagagcttatctatacagcaactagaagtatatagaacaacaatggtcgaacgacgggttagtttcacagctcaataa

SEQ ID NO: 94 - DNA, 873 bp, Saccharomyces cerevisiae
atgcgtggtttcagtggtcaaccattgagtgatgatgataattatagaattgaaaagactcaaaggaacacaattcctgaacgtctccattttagcagagagagaaatatgcccattgcaagtatattcgggactagaggatattttgtattctcaagtgagcaatcctatgacaaattcaaacagacaaactttaatatcagtactctagatgcggatggtgtaggtgttcctctttttcatattgtccaaagttataacgttattggcaaaattactcggagctcgccggatttctatatctacaagtacgttttacaaggggtgcaagatccgcctttatactctgattgtaaagttatttgtcaagataaagtttttcgtttatgcaaaattttatattgtgaaatttatgctcatcaaggattttttgaaactaaatacgatttcttctatccttctaaaacgcagccggtcaaaaaataccaaataatcaaacaaagtaatatgcgagatctatattccactttggacggtatgcgttttcgttggcatgtgaaattctacagcgatcattttcgattgatgttcctagatgaggacaggctcaattactcaaatagtaaccaaaaggaaaggcaaaaaccagatcaaggaaaaagtaaggctccagatttcgtaattggccattatacaagaactttttccgatatactccctagatccacgtcaaaatgctccaatcttattattggagaacactcaaagccagactctcttggtatcacgaccgttcctgatttgactcaggaatttgcctgtcagggagctttaatccattatctgctgcatatagaacgagaaagaaaataa

SEQ ID NO: 95 - DNA, 3252 bp, Saccharomyces cerevisiae
atgtcatctgaggatatcatttatgatcctcagttcaaacctgttcagggaatctacgagaatagattaagacaatttattgatactggtggggattaccatgacttaaatttacccaagttttatgataagaagcgcatttcattagatcatgatcacgttaaggtttggtggtaccaggtttcttttgaacgtggatcttcccctgtttcccctgataagaggccatcttggaaatctattattgaacgtgacaagaagggtgaattggagtttagagaagcgaacataaatcagccctttggacccagttggtctaccacttggttcaaggtgaaaatctctttgcctgaagattgggttaaatcaaacgagcaactacttttccaatgggattgttctaacgaaggaattgtcatagacccaaagactctaatccctgtgactgctttttcaggtggtgaaaggactgaatatgttttaccgaaaacatcggatgggaaacatttcttttacatcgaagctggtaataatggtatgtttggctgcggtgcaggatccactataaatccaccagatgataatagattttttcatttgagaaaagctgatatcgtttggcccgatctagatgctcgtgcattgtatatcgatttttggatgctaggggatgctgcaagagagctacctggagactcctggcaaaaacaccaggcaagacaactaggcaatgcagttatgaatctttttgacccgaatgatcgttcaagtgttcgtaaatgtcgtgaattactacaaagggaatactttgactcctttttagaaagcagtaaggtttacgaacaaggtgaatctcaagttttaacaaatgtttatggtatcggcaactgtcatatagatacagcttggctatggccattcgcagaaacaagaaggaaaattgtgagatcttggtcttcccaatgtactttaatggatcgcttcccagagtataaatttgttgcttcacaagcccaacaatttaaatggttattagaagatcatcccgaatttttcaataaagtgttaattccaaaaattcagcaatctcagttttttgctgttggtggtacatgggttgagaatgataccaatattccctcaggggaatcgctggcaaggcaattcttttttggtcaaaggtttttcttgaagcattttggtctcaagtcaaagatattttggttacctgacacctttggttattcttcgcaaatgccacaactttgccgcttatctggtattgataaatttttgactcaaaagctttcctggaataacatcaacagttttccgcatagcacgtttaactgggcagggattgacggttctcaattattgactcacatgcctcctggtaatacgtatacagcagattcacacttcggtgatgttttgcgtactgccaagcagaataagacaccagaatattacggctccggtttaatgttgtacggaaagggtgatggtggtggaggaccaactgaggaaatgctgcaaaaaatgaggcgtattagatccatgaataacagaaatggtaatgttattccaaagttacaagttggtataacggttgatgaattttatgatgacattttgaaaaggactaaccaaggccatgatttacccacatggagtggtgaattgtatttcgaatttcatagggggacatacaccagtcaagctcagaccaaaaaattaatgaggttgtccgaaattaaactacatgatttggaatggatagctgccaaaacatcagttttatatcccgattcgtataaatacccttccaaacagattaacgaactttgggagaatgttttgttatgtcaatttcacgatgttctaccaggatcatgtattgaaatggtatataagtatgaggctgtccctatgttgcacaacgttgtgaaagaatgtacttccttaatagacaaaaccgttcaatttcttcagagtcagagtaaggcagatttggttgagatgagaacattaacttggtcaaaaccagaaaaggtttctgaggagtgctcgttgaacggtagttacacgtcctctgtaaccgggtacgatgactatatagtccttgccaatgggaagttgaaagttatcatttgcaaaaagactggggtgatcacaagcattacggatgaaactttgggggtagaatacctggacacggaacatggcagaaacaaattgggcgccaaccagtttgttatttatgatgataaacctttgggctggcaggcttgggatactgaactttattccgtcaaccaatacaagtatgtaacaaagccgaagaaagttcaagtttcctgcaacacaaaagagaaatgtgctgttgaggtcatttttcaaatttccgaaaaatgcaaaatcaaatcagtgatatcactcaatgcaactgcggtcactgatgctaaattaagtaaagtagacatttctacgacggtagaaaactgggatgctagaaacaaatttttaaaagttgaatttcccgttaatattcggaacgattttgcttcgtatgaaactcaattcgggattaccaaaagaccaacacattataatacctcatgggacgtcgctaaatttgaggtttgccatcacaaatttgctgattattctgaatacagcaagggtgtttcaattttgaacgattgcaaatatgggttttccacacacggtaacttgatgagattatcattattaaggtcaccaaaggctccggatgcgcatgctgatatgggtactcatgagataaaatatgctatctatccacatagaggagcactatcaagcgacactgttaagctcgctcacgaattcaattattgcttcaaatacaaactccccaaagatattggcatgaattttgatgacatcataagcatttccggagatgagaatgtcattttgtctaacataaaaagaggcgaagatgatagtgctgtcaagtccaactattcattaaatccaagggatgaacaaagtattgtggtaagggtttacgaatctcttggcggggaatcttttgcttcactaaataccacactaaatttgaagcgtattgagaaggtcgataacttggagatgaaagtttataagagtttgacagcaacgcgagacgaatcaaatcatgcaataaacagaattcccattaaattgagaccttttgagattgcctcattcaggttgtatttctga

SEQ ID NO: 96 - DNA, 1704 bp, Saccharomyces cerevisiae
atgtccggtgttaataatacatccgcaaatgatttatccactaccgagtctaactctaactcagtagcaaatgcaccatctgtaaaaactgagcataatgactctaaaaactccctcaacctggatgccactgaaccacctattgacttacctcaaaaacccctctctgcatataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacaaatcagaggaaccctggtccaattgtaccagctgatgtgtacgatgggtatttttctaggatactgtaccaattacggtaccaagaactatcacaacgccactcaatggagagtcggccttggtctttgctttgcctggactacattcatggttagtggaatgatgtttgtaccagaatcaccacgttacctgattgaggttggtaaagatgaggaagcgaaacgttcactttcgaaatccaacaaagtctcagtcgacgatccagccttgttagcagaatatgacactataaaggcgggaatcgaacttgaaaagctggcaggtaacgcatcatggtctgaactactctccactaaaacaaaggtctttcagcgtgttctcatgggagtgatgatccaatcgctgcagcaattaaccggtgataactacttcttttactacggcaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcctgacgctggaggaggtgaatactatgtggctggaaggtgtgccagcatggaaatcagcctcatgggtgccaccagaaagaagaaccgcagattacgatgctgacgccatagaccatgacgatagaccaatctacaagaggttcttttccagctaa

SEQ ID NO: 97 - DNA, 1776 bp, Saccharomyces cerevisiae
atgtctcacaaacaattcaaatcagatggaaacatcgttactccctacctacttggccttgctcgaagcaatcccggccttacagtgattaagcacgacagagtggttttccggactgcgtcagctcctaattcagggaaccctcctaaagtttcattggtttctggaggtggcagtggtcatgagccaacgcatgccggttttgttggtgaaggtgccttagatgcgattgcagcaggtgccatttttgcttctccttcaactaaacagatctattctgctattaaagctgttgaatctcctaagggtaccttgatcattgtaaaaaattacaccggtgatattatacattttggtctcgctgctgaaagagctaaagctgctggaatgaaagtcgaactggttgctgtaggagatgatgtctctgtcggtaagaagaaaggttctttagtcgggcgtcgaggtctcggagccaccgtattggtgcataaaattgctggggcagccgcttctcatggactggagttggcagaagttgccgaagttgctcagtcagtagttgacaatagtgtcacaattgcggcatctcttgatcactgcacggttcctggccacaaacctgaagccattttgggcgagaatgagtatgaaatcggtatgggtattcataacgagtctggtacctataagtcttctccgctgccatcgatttctgagctcgtttcccagatgcttcctcttcttctcgatgaggatgaagaccgttcttatgtgaagtttgagcccaaagaggacgtagttcttatggttaacaacatgggtggtatgtctaatctagaattgggttatgctgcagaggtcatttctgaacaattgattgataagtatcaaattgtgcccaagagaacgattactggagcattcattactgcattgaatggtcctgggtttggtatcactcttatgaacgcttcaaaagctggtggcgatatccttaagtatttcgattatcctaccacagcgagtggatggaatcaaatgtaccattctgccaaagattgggaggtacttgccaaagggcaggttcccaccgccccctctttaaagacattgaggaatgaaaaaggttcgggtgtgaaagctgattatgacacttttgctaaaattttgcttgctgggattgcaaaaattaacgaggttgaaccaaaggttacttggtacgataccattgcaggagatggtgattgcggaactactcttgtgtccggtggtgaagcattggaagaagctattaaaaaccatacgttgcgcctcgaggatgctgctcttggtatcgaagatattgcgtatatggttgaggattctatgggtggtacgtccggtggtctgtactctatctatctttctgctctcgcacaaggagttagggattctggggacaaggaacttactgcggaaactttcaaaaaggcatcaaacgttgcactagatgctttgtataagtatacgagagcccgtcctggttacaggactctgatcgatgctctgcaaccttttgtcgaagcgctgaaagccgggaagggtcccagagccgccgcccaagctgcttatgatggtgccgaaaagacaaggaagatggatgcccttgttgggcgtgcttcttacgtggctaaggaggagctgagaaaactcgacagcgaaggtggattaccagatccaggagcagttggtcttgctgcactactcgatggatttgttacagctgctgggtactag

SEQ ID NO: 98 - DNA, 1986 bp, Saccharomyces cerevisiae
atgagcggttttaaatgctatttgcaattgggtgacaggctctctcaaatatggctaaataagtatactttggttttgctgctagcaatgctgaagcttctgtttttctccaaatccatacaacatgcgatagaagtctcggaaacgtatattttgtccaattgttacagtattgattcactatactccaagatgacagacaacacgccgcactatttaggtatcatggggaattatcttatcgagaagggtatggaggagactgttaaagctacgctagagacgttatcacttatagtatatgcgagcgaggggctggtaaactttgccattgacctgtatttgggcacttatgcctgtttgattgttagtgccgttgatggtaccgtggacgttgctactaacattacagaaaaactgattagcttagtcaatgatacagtttcaagtgtggctaatgaattggatacgggcttgaatgacatctccaaaataatcaataaagtgatcaaggccgcatccaaagtagagaattttttcacaggtgatgacgatgacagtaacatgacgtcgtcaatcaaaagcgtcaacttaaccatatctgcgcttcacaatttatacattccttcctcaatcaacgataagcttgaagagttatcggcaaagacgccggactttgcccaggttaagaatacaaccaagaacctgatctcggttcccttcaatgaagttcggaagaatatcaaggccgtgaatgccagcaatataatcggagatacctccgttttgtacgtacctcccgtgtcccttgacaacagtactgggatttgctcatccaatcaatcagaaattttggccttttattccatcttgggacatgtcctgaaaatagccaccgtagtgtgcattaccgtattgatatgcttcgctgttggtgcgatggcgcccgttgcatggaatgaaatcaagctctggaggcgcctttgcggaatgagagaccattacatgctgagcaggcaagattcgtatacgtccttttccagtgaaaacacgcacgaattgaaagatccatttagagatcctcctatacaaaatggccaatatgatgtcattgcaagctatcagcagtgctttcaaacatggaacacaagaatagcaggctggatgacaaatcttgttacctttggaaaatcaccagagaacattgacccaaagactaaacaaaaaatagaatgggtagtggcttatatgacctccgaaagagcactgtgtgttcttggaattggacttttgggaattttagtgtgcatatgccaatttgtcatgatagcactgttaaaacacaagataagccattcattgacttctaatgatggtgacggcgttcaaaatttgctgaagtctagcactgccgtcgatatagagaaccaaatgagcctttggagcgttcagactaataaatatataaatactacggagaccaatatcaatcaggaagtattcgggtggataaacacgacaacactttctgtgaacaatacagtggccaccatgatctctgatatagacacaactttagcagatgtattcaatggaacactgctatataacccaatgaaaaccgtggtcggatgtgccattgaaaataagctctacacaatagagaaggcaatgacgtggattcacgacaaggctcagctgcatatcccgagaattaatgggacacaaatcaagcaagctctggcaaagcaaaccgacaacagcactatacccactgcaagctccacttctgccgccacagaaaacttactggagaaccttgtgaatgatatgagagaaggacttttaaaaattctccgagcttaccaccgtataactctgggagaactcacggtagccttggtcattcttgcggtgtggctcgtacaattgcccatagctctggtaattctccgattacgtcttcgcaaagccacctttgactga

SEQ ID NO: 99 - DNA, 1593 bp, Saccharomyces cerevisiae
atgtctgctaccaagtcaatcgttggagaggcattggaatacgtaaacattggtttaagtcatttcttggctttaccattggcccaaagaatctctttgatcataataattcctttcatttacaatattgtatggcaattactatattctttgagaaaggaccgtccacctctagtgttttactggattccatgggtcggtagtgctgttgtgtacggtatgaagccatacgagtttttcgaagaatgtcaaaagaaatacggtgatattttttcattcgttttgttaggaagagtcatgactgtgtatttaggaccaaagggtcacgaatttgtcttcaacgctaagttggcagatgtttcagcagaagctgcttacgctcatttgactactccagttttcggtaaaggtgttatttacgattgtccaaattctagattgatggagcaaaagaagtttgttaagggtgctctaaccaaagaagccttcaagagctacgttccattgattgctgaagaagtgtacaagtacttcagagactccaaaaacttccgtttgaatgaaagaactactggtactattgacgtgatggttactcaacctgaaatgactattttcaccgcttcaagatcattattgggtaaggaaatgagagcaaaattggataccgattttgcttacttgtacagtgatttggataagggtttcactccaatcaacttcgtcttccctaacttaccattggaacactatagaaagagagatcacgctcaaaaggctatctccggtacttacatgtctttgattaaggaaagaagaaagaacaacgacattcaagacagagatttgatcgattccttgatgaagaactctacctacaaggatggtgtgaagatgactgatcaagaaatcgctaacttgttaattggtgtcttaatgggtggtcaacatacttctgctgccacttctgcttggattttgttgcacttggctgaaagaccagatgtccaacaagaattgtacgaagaacaaatgcgtgttttggatggtggtaagaaggaattgacctacgatttattacaagaaatgccattgttgaaccaaactattaaggaaactctaagaatgcaccatccattgcactctttgttccgtaaggttatgaaagatatgcacgttccaaacacttcttatgtcatcccagcaggttatcacgttttggtttctccaggttacactcatttaagagacgaatacttccctaatgctcaccaattcaacattcaccgttggaacaaagattctgcctcctcttattccgtcggtgaagaagtcgattacggtttcggtgccatttctaagggtgtcagctctccatacttacctttcggtggtggtagacacagatgtatcggtgaacactttgcttactgtcagctaggtgttctaatgtccatttttatcagaacattaaaatggcattacccagagggtaagaccgttccacctcctgactttacatctatggttactcttccaaccggtccagccaagatcatctgggaaaagagaaatccagaacaaaagatctaa

SEQ ID NO: 100 - DNA, 1923 bp, Saccharomyces cerevisiae
atgctaaatcagcacacaagttcagtaccggatgacgaacatctgcagatggcacaccaaaatagcagttcagaagtgagaaatgaggcagcggtcccagatcaacttttgactcctttacaaccgtataccattttattgaaagatggagaaacaatagctacgatgtatcctatacctgcgtatcctgatttattgccgctagggctcttaaatttccttctagatgaatttaacatggaagtggaaaagggagatagttttccttattacgagactttatcactagaagaattcaaaaatgtctggtttcataatgatggtcacgtttgtattatggtgttaggcgaaataccagaactggattatagtatggatactgaagcggacacaaatgataattttggaacagaaatagaaaccacgaagcacaccacccaatataagaaacgaaaagaacgtcgcaatttaaatctaagtatgcagtgggagaagcaatgtctaggcatatttgacctcaaaccagcataccctggacggtcagcgcatgtggtcacaggaacatttctggtcaatgctggtattcgtggaaaaggtattgggaaaacactaatggaaacattcatagaatggtcaaagaaattaggatttacgtcctcctttttcccgttaatttacggaacgaacgtaggaatcagaagaattttggaaggattgaactttaggcggattggaaagctgcctgaagccgggattctcaagggctttgatgtcccagtagattctttcatgtatggtaaagagttcacacatattacgaaaagtatagatttgttacgagatcctcaaaagagtatcgaaattgggaaatatgaacgattaaagcattttctggaaacaggcaagtatcctttacattgtgatagaaacgaaaaggctagattaagagtactttccaaaactcattcggtattgaatggcaagttgatgacaaaaggaaaagaaatcatttatgacacggatcaacaaatccagattgcattagagatacatttaatggaacatttaggcatcaacaaggtgacctccaaaattggtgaaaaataccattggagaggaatcaagagtactgtttcggaggtaatctctcggtgccaaaaatgcaagatgaggtacaaagacgggacaggggtaataattgaacaaaagagagcagttaagcaggcgcatatgctaccgacgcagcatatagaaactatcaacaatccaagaaaaagcaagaagcatgataatgcgttattgggacaggcaataaatttccctcaaaatattatttccagtacgctgaatgatgtggagggtgaacccactccgccagacactaatatcgtacaacccacattccagaacgccacgaatagtcccgcaacaacagctgaagccaacgaagcgaataaaagatccgagtttctttcctcaatacagagcacgccactattggacgacgaacagtcaatgaattccttcaatagattcgtggaggaagaaaactcaagaaaaagacgaaaatacttggatgttgcctccaacggaattgtaccccatttaacgaataacgaatcgcaggatcacgcgaaccccgtcaaccgtgatgaacgagatatgaaccattcagttcccgatttagatagaaatgaccatactataatgaacgatgctatgttgagcctcgaagataacgtcatggccgctctagaaatggtccaaaaggaacaacaacagaagataaatcatcgaggtgaagatgtgactggccaacaaatcgatttgaacaacagtgaaggtaatgagaattcagtcactaagattgttaacaacgaatctaatacatttacagagcacaattctaatatttattattaa

SEQ ID NO: 101 - DNA, 549 bp, Saccharomyces cerevisiae
atggtagcctccacgacggtaccatatctaccaaagatctttttcaatttaactggatcacgacaactccatggcatatttctgataattaatttcggtttaccttttagcatggagtcttcaccatcagcatcgtcctcatcttcattgttctggcccgttattttctcagatgactcaggtgtgctcttttcaaccacttctgatgttttctttgaacgatctcttcttttagcaatgtctaccctcaagatatgtccgttaaatttggtctttctggccttagctagggcttcttttgtgtcatcctctacagcaaaactaacgaacccgaagcccctggaccttttattcgtgtccttaacaactaccgcatgcttgatcggagcaaaattggaaaagaaatctgccagctgctcatctgtgacatcctggggtatagacctcacaaacaaagtcttcatatctaggccgtcgtcattttgttttgagacattactagaaggcacttcaacattttctattgtttcttccatctcactttggtag

SEQ ID NO: 102 - DNA, 1860 bp, Saccharomyces cerevisiae
atgatcataagattgcatttttactacctcctcactttagtttaccatttaggacttgtaggtgcgtatgaaaaagcagcaagaaagagaattcaacctcccgatttgatacctggtcctccgggacataaacttggtgatgaaagaccaccgcattacgaccaccggccaccttataaaaaacacatcgacaacattccagcttacaatctgactgatttgatagatgataaactactaaataaatatgaaaactcatgcacggtaaatgtattgacaggtggcttcatctctctagcaagtaattcgtggcacttacgtgcttataattacactttaaattacccatcctttttgatccgatgcgataatggcagtgcaaatcctaatttctctcatgtcttacaagactttgtttatgacatcaacaacaaattcaacgttcaagatgacagtagtaaatacatcggaaaagacccatttcccttaggaatgataatgatcacctttgcttctgggtgtatctgtgtggcaacatggatgctatttttggttgtcttattactgccatccgataatcataatagaagaaataaagttgtacatgtttacgtccttttctctgcgattataagaactgtatttctaaacgagactatagccgtcatatttgacagccaatatcacgatgactaccaggatgcgagccaatttgaatcgttcatcgtagaaactgcaccatataaaatatgtgaattagttgcaaatattttgagtgatataaactggatttatattgttcactacttacagtccaattatggaaaaccaacttggaattggatcccatttaaaatgaaaaaggggacacatatcataattaccgtgggttgcttcctctcactagccgataacattttattcgcaaaccttctttggagaaagaaccttgtagttttgaaggtattttacaagctaatcgaattactgatttacacaattttcatctccattatttgttacttcacatggcataattttgcttacatacttttaccgaaaactgctgaaattaatacggacggtaagtgtaaaacgaaattgagaattctttgggaaaattatcacgaaactataccattattggcgtataatattcttatatttattttattctatttcaccacaatttttttcgctgctttcaccaaacatgttagaggttggacatttaactttgttcatcttttgaaagttttaataacagtgaacgtttggggcttaattggagtattggaaaagagggagctgcacataagcaaaaaaacagtccttggacgaaaaattaacaatagggacaaatttttcgccaatccaacagtcaattattacggagaagatttaggcaagcatttaagcgccataacgttaaacagggatttaaacactactaaaagtaacactacttcccacgattcatcaagtttagtaggatccccttcacccacctggaaatctccaatcgaaagaataagggacagaagaagaagacataagataatgaaaagtgagaataaatttgggcaaaatcccagttttggaagtaaatcgaatggcaaacctaatactaaaacgacattatccaaatatcgacagctattaaggaagcctaggcgaaaaaccaattcatatgaaccaaaaaatggcattggacagaataaagaaggctcaactgttagaccaggagccgacaaacatattagagattccaattatctagctacagacatcagtgacaacgaaagtatggaaaccgaacttcgaaccaaccacatttataattacgaaaatagtgattaa

SEQ ID NO: 103 - DNA, 810 bp, Saccharomyces cerevisiae
atgtctttcactaaaatcgctgccttattagctgttgccgctgcctccactcaattggtttctgctgaagttggacaatatgaaatcgtcgaatttgacgctattttggctgatgtcaaggccaatttggaacaatatatgtccttggcaatgaataatccagactttaccctaccatctggtgttttggatgtttaccaacatatgaccactgctactgatgattcctacaccagttatttcaccgaaatggactttgctcaaatcaccactgccatggttcaagtgccttggtactcttctagactggaacctgaaatcatcgctgctttacaaagcgcgggtatcagtattacctccttaggtcaaaccgtttccgaatctggttccgaatctgccactgcttcctcagacgcttcttctgcttctgaatcctcttcagctgcttcttcttctgcttctgaatcctcttcagctgcctcctcttctgcttctgaatcctcttcagctgcttcttcctctgcttcagaatcttcttctgctgcctcctcttctgcttctgaagctgctaagtcttctagctctgccaagtcttctggctcttctgctgcttcatctgctgcttcatctgcttcttccaaggcctcttctgcagcttcctcttctgcaaaggcctcctcttctgcagaaaaatctactaatagctcctcctctgctacctccaagaacgctggtgcagctatggacatgggcttcttctccgctggtgttggtgccgctattgccggtgccgctgctatgctcttatga

SEQ ID NO: 104 - DNA, 1470 bp, Saccharomyces cerevisiae
atgcaagaatcaaaagaaccacaaaataaatttgaaggttgtcaaagaatatcttcatcttcatccacactctttggaggaacctccttcgaggaaccgagatgtggaacatcccaaggaaaggaagaagacgctttcgcatgcaataatggagatcactgctcgagcataacgaatgttcaggaagatgactttgtccttccagaactattgccgtcattcgaaatgtatgaaaatttgctcagcaatatacctcaatctagtttcgatacatactttccggagaatccacctttttatgaggttgcttcccgaaatcagagtattccttcggaaggtgagtctgggaatgatatgcggattcttaccggtgatatcgttggcccagataatcatgaagtgactgttgatggccgccggtttgcttccggccctgctgagtctcaaattcgtaattatgatgatactaaaggtatcccagttgagaatatatacgcattgcctaggattaaaacccccatagcgactgaattgtacgtcacaaagacggctccaaaatttggacagcttcctaaacacgagagcatgctaagggaatacacctctggggatataattcacggttatttcactgtagaaaacaaatcaaccaaacctataaaattcgatatgttttatttaactttggaaggtacgacaagttcaaaaacacagtcaccctttggaatccaaaaaacgacagaaagaattttgagaatggtagatatggcagcgagttggtcatataatcatgaagacgtgaacacgggggaagacctttgtggattttttgactccattgataaaacaagctttggattaccgaatagcaggatactaaatccaggtgataaacgtaagaaatttttcacttttaaaattccgaaccagttattagacgtaacctgtaagcacggtcacttctctcactctcttttgccccctacattagggtttgatagaccatcgagttctcatccagagctttctactctaaaattttcggagagtttaggttatggtcgtttgtcagaaagaggttcctcactatggttaaacgacagttctagtggcagcttaataaattactcaataaatgctatgatagtaggcaaagacgtagcttctgggcgtgtttgtttaatgagtgaaaaaaagtatagcataaggatagttccatttggctttcaaaacaatccaattagtagggagaagtgcctcaaagacttagaggatttcgatattgaaattgcaaacaggcttggaatgatcgaaaaagtcttttctaaaatagagcgagcgattcccattcataaggaggacatacaggaggcgaatcgctctgatcaactatcacccctaagaggtaagtatgaatggaacgcggtagctggaaatactgaaaacggaacacttaaaaagaaacactag

SEQ ID NO: 105 - DNA, 1485 bp, Saccharomyces cerevisiae
atgctgctgaaaaattgcgagacggacaagcagcgagatatacggtatgcgtgtttgttcaaggaacttgatgttaagggaaatggtcaagttactctagataatctgataagtgcttttgagaagaacgaccatccgctcaagggaaatgatgaggcaatcaaaatgctgtttactgcaatggatgttaacaaggactctgtagttgatttaagcgatttcaagaagtatgcttccaatgccgaatctcaaatttggaacggcttccagaggatagatttagatcatgacggtaagattggcattaacgaaataaataggtatttgtcagacctcgacaaccagagcatatgtaataatgaacttaatcatgaactttcaaatgaaaaggtgaacaaattctcgaggttttttgaatgggcgtttccaaagagaaaagccaacattgcgctacgaggccaggctagccacaaaaagaatactgataatgatcggtcaaagaaaaccaccgactcagatttatacgttacatatgatcaatggagagactttttgctgctggtaccgagaaagcagggttcgagacttcatactgcttattcctatttttacctattcaacgaagatgtcgatctgtcctcagagggagatgttactctcataaacgatttcattcgcgggttcgggttttttattgctggtggtatttcaggtgttatttcaaggacttgtaccgcgccatttgatagactgaaagtgtttctcatcgcaagaacggatctatcctcgatcttgttaaattcaaaaacagatctccttgctaaaaaccccaatgctgacataaacaagatatcatctccattagcaaaggctgtcaaaagcttatataggcaaggcgggataaaggctttttatgttgggaacggtttaaacgtcatcaaagtttttccagaaagttcgataaagtttggttctttcgaggtcaccaagaaaataatgaccaaattagaaggctgccgcgacacaaaagatctttcaaagttctctacttacattgctggtggtttagctggtatggcagctcagttttccgtttatcctatagatactttgaaattcagggtgcagtgcgctcctttggacacaaagttgaaggggaataatttgctctttcagactgcaaaagatatgtttcgagagggggggggtcagattattttacagaggtgtcacagtcggtatagtgggcatatttccctatgctgcattagatttggggactttttctgccttaaaaaaatggtatattgccaaacaggcaaagaccctgaacctaccacaagatcaggtcactctaagcaacctggttgtacttccaatgggtgcattcagtggaactgtaggagcttctgttgtttatccaatcaatcttttaagaacaagactacaagcccaaggaacatatgcacatccttatgtgtataa

SEQ ID NO: 106 - DNA, 2316 bp, Saccharomyces cerevisiae
atgagtgaacccgaagtgcccttcaaggtggtggctcagttcccatacaagtccgattacgaggacgatttaaattttgaaaaagatcaagagattattgttacgtctgttgaagacgccgaatggtactttggtgaataccaggattcaaatggcgacgttattgagggtatcttcccgaaaagttttgttgctgttcagggatctgaagttggaaaggaagccgaatcatctccgaataccggttccactgagcaacgtacaatccagccggaagtagaacaaaaggacctaccagagcccatttcccctgaaacgaagaaagaaactctgtccgggccagtgccagttccagccgctacagtgccagttccagccgctacagtgccagttccagccgctacagcagtatcagcacaggtccagcatgatagtagtagtggtaatggcgaaagaaaagttcccatggattctccaaaattgaaggctcgcttatctatgtttaatcaagatataacggagcaagttcctttaccaaaatcaactcacttggatttagaaaacatacctgtgaaaaaaacaattgtggcagatgctcctaaatactatgtcccccctggaattccaacaaatgatacgtccaatcttgaaaggaaaaagtccctaaaggaaaacgaaaaaaagattgttcccgaaccaattaatcgtgcacaggtggaaagtggaagaatagaaactgagaatgaccaattaaagaaggatttgccccagatgagccttaaagaaagaattgctcttttacaggagcaacaaagattacaggctgcaagagaagaagaactcttgagaaaaaaggctaagctcgaacaagaacatgaacgtagtgcggttaacaagaatgagccctatacggaaactgaagaagcagaagaaaatgaaaaaactgaaccgaaacctgaatttacgcctgaaactgagcacaacgaggaaccgcaaatggaattattggcacataaagagattactaaaacctcacgcgaagcagatgaaggcacgaatgacatagagaaagaacaatttttagatgagtacacaaaggaaaatcagaaagttgaggagtcacaagcagacgaggcaagaggagaaaatgttgctgaggaaagcgaaataggttacggccatgaagacagagagggagataatgatgaggaaaaagaagaggaagatagtgaagagaatcgtagggccgcattgagagaaagaatggctaaactatctggcgctagtagattcggtgctcctgttggttttaaccccttcggtatggcttctggagttggaaataaaccatcagaagagccgaaaaagaaacagcataaggagaaggaggaggaggaacctgaacagctccaagaactacctcgtgccatacctgttatgccatttgttgacccaagttctaacccattttttaggaaatcaaatctaagtgagaagaatcaacccactgaaacaaagacgctagatcctcatgcaaccacagagcatgaacagaagcaagaacatggtacacacgcctatcacaatttagctgctgttgataatgcacatcccgaatactctgaccatgattctgatgaagatactgacgaccacgagtttgaggatgcaaacgatgggttgagaaagcattcgatggtggagcaagcttttcagataggtaataatgagtcagagaatgttaattccggagaaaaaatttaccctcaagaaccaccaatctcccaccgtactgcagaagtatcacatgatattgaaaattcatcacaaaacacaactggaaatgttttgcctgtctcttccccacaaacaagagttgctcgcaacgggtcgataaattctttgactaaatccatttcaggggaaaatcggcggaaatccataaacgagtatcatgatacagtttccactaattcatctgcattaacagaaaccgctcaagatatttcgatggcagctccagcagctccagttctaagtaaggtgtcacatcctgaggacaaggtgccacctcacccagtgccttctgcaccctctgcacctccagtaccctctgcaccttcagtaccctctgcacctccagtacctccagcacctccagcactctctgcaccttcagtacccagtacccagtacctccagtatcttcagcacctccagcactctcagcaccttcaatacctccagtacctccaacacctccagcacctccagcacctccagcgcctcttgcgctgcctaaacacaatgaagtag

SEQ ID NO: 107 - DNA, 309 bp, Saccharomyces cerevisiae
atgcgtactttcactgactttgtttctggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatgttttgcgtgtgtgctgcccaagttga

SEQ ID NO: 108 - DNA, 3093 bp, Saccharomyces cerevisiae
atgaaggcatcgcttacgtttagtctctccggaatatacgccccctgtagcatttctagggatatatatctcgaatacggcgataaaaaagctgaatgtttatatgggacaattagattgcctcagtacggtccaggttgcacgcctggtaaaattgtacattgtgtcctggatgattcactgcccttctgtagcattgttgtaccttccaaactttttgggtttatgccgacacagcccactatggatttttgctattttgaacccatattagacaatgtagtacctgtactggatagcgtaacgtttctgattaatgaacaattgtactcaaaactaatggacctaccgcaagagatgcaacaaatacaatttttgcattacaaatataacatcaactccatggaaaccgtggttcattctcgagatattttaacatctggtctttgccaaattttaaactgctcacctttcccgcagggccttgttgattttacagaaacccaattgatattagtaaatgatactgagcagaaactaagtgctctaaaatatgctaacgaagatgaagaatatgcattacctaaaatagggacaaattctgctttatcaattgatcttgaatctctcccctgcacaatttcaagagatcttttgcgacctgcacctcacatcaatgatgataattcaatatatgcctttacagacgctgaaactctactgcgcctggatgtcacaagtggatcgtttataacagtgtcaaatatgggttgcgtcaggctagttaagctgtttgttttactactccccaacggctttaaaaaaagaacaatatacgcacctcccaaaataatagcaagctttccagactgcagcgtcgtgacaatatcaaagtccaatataggccatacagatattcccattgctaatcaagttttcatctcaagagttggaggctggcttcaatctcagaaatgctttcaaaatattattctaacaaccttgaaaaagttttttagcgagagcaaaaggattctttgtcaaaatgatttaatcccaatcgcttttgattcaagtatggctgatctcaatatagcagaggaaaatgatgagtctgatgacgaagatgagctagggcagtactacaagaacgattcccttgtatggttctttgtcacaagcgcagagctcgattgcttctctaaagataattctcattttattattgatcccaatcggacgaagctaataacaactaatatcactaacagaagaccattacccttgagtagatccaatcttcagagatattacggttttgctgaaactttttactatgatttgcatatcttcccctatgtaagacaattggttaacatattagaaacttccttcaattgttctcaaaggggaatcaccctaaatgcctctgtgttacttcattccactacaaacaatgtgggcaaggctacaatggtgagatttgcttcaaaatatcttggtatacatctactggagatagattgcctttcgctcacttcaaattcaagacaactggattcaacatctaagattattggttacattagggctaaatgtgaaaatgtcctaccgtacgcatcacctgctgtgatttttttggctcatttggattcaattttgcttgacgtaaacgctaatcaagatccagaggcaatcaaattacaaaaatctataaacttcgaaatgtctaaacttctggacgattttacgtttaaattcccaggaactacatttgttggctccgtaaataacatagataacgtgccttccagctttagatcacatatgagatttgagattctcgtacccgttccgtctgaagcacagagactgcgtatctttcagtggtacttatcttcacatgaactaaacagagatgttcaacaaaaggttccagtatcttacatggataatatttcattttcatcactctcttcatattctgctggtttaactcctttagacatcaaatcaattgtggaaacggcacgaatgacggctactgcgcgtttttaccaagaatcaaagaagtgtggatggcttccgcaatcaattttgatcactcaggaggatttatcaaaagctacttcgaaagctaggaacgaattctcggtttcgattggtgccccacaaatccctaacgtaacttgggatgatataggtggtattgattttgttaaaggtgaaatattggacacaatagacatgccgctaaaacatcctgaattatttacctcaggtatgaaaaagagaagcggtattcttttttatggtccaccgggtacaggtaaaactctaatggctaaggccattgcaacaaatttttctttaaatttttttagtgttaaaggccctgaactgttgaatatgtacattggtgagagtgaagctaatgtgcgcagagtgtttcaaaaggcgagagaggctaaaccttgtgtcatatttttcgatgaaatcgattcagtagcacccaaacgtggtaatcaaggtgattcgggtggtgttatggatcgtatcgtttcacagttactagcagagttagatggtatgagtaccgacgctgacggtgtatttgttatcggagcaacaaacagaccagacttattggacgaagcactactaagaccaggacgattcgataaattgttatatttaggcattccggatacggataccaaacaattgaatattttagaggctctgactcgcaaattcgtgctcgacaacgacgtaaagcttattgagttggcaaagctatgtccatttaattacaccggggcagatttttatgctctctgctcagatgcaatgcttaacgccatgtcaagaattgcacgcatggtagaaaaaaaagtttctcagcataacgaattgacgggagagaatatttctacacgtcgctggtttgataagattgcgacaaaagaggatactaaggttgtcgtaaaaatggaagacttcttgaaagcacaagagcagctcaccccaagtgtgtcgcgggctgaactgaatcattatgaagcggtgagagctaattttgaaggtgcttaa

SEQ ID NO: 109 - DNA, 1626 bp, Saccharomyces cerevisiae
atgcctatcttatcactatcttcaacacggaacagcgtgttaacaaggatatatgactaccttaaagcattagtgcagcaagtgattgtgcccaatgtggaagacgacaaatcttcgaaaagtactcctttcgaaaagttagaacctgcgaaacagaaccatccacagaaagactgctgtgctaccgaaaaggacgatctggttgacgtgagcgaattatttcccaaacagaacaacaaacaattgagtctaacatcaaaatcttcagttgtaccctgtgctttaaatttggataacctagaaacacctttctcaattaaaattgataataatggtgcagtcactacacagttgaacttggacgaaccgattttacggggccctagccgcggcgagccagcaaagttacagaatgacttgataagttctcccccgctagaggaatcctatatcaataatgaccagtacaaagctcttttcccctctaatttccttccaatcacgcccgtaagtagcgtaatcactcctgcatcgaagaaaagtattgatgaatctcccctatccgatgaggttcaaggaattgctgatgagtcatccgaaactttaccatatatatgtcactattgcgatgctaggttccgaatcagaggttacttaacacgacacataaaaaagcatgcgaaaaggaaggcctatcactgtccattttttgataatagcatttcgcaagaattgcgatgccatacttctggggggtttagcagaagagatacctacaaaacacatttgaaatctagacatttcacttacccagaaggtgttaagcctcaggaccgtaataaatcacctggagtgtgcactcaatgtggggaacactttagcactagtgagagctgggtggaaaaccacattgaggctgggagttgcaaaggtttaccagaaggctattcagagggaatacgagagaagaaaaagacgtctaaaatgaaaatgataaagacttcggatggccaaacaaggttcatctcatccgacgaaagtgtttccgaaccagctttacaaaataagaattgtatagaagcgacagtaatgcagtccaaggaacgccctaatgacaagatcataccaaccaaaaccgaaaaaaacgattttggaataggcactcaatggtttgaacgcaaacaaatatcaagacctacacaaactacacaatcaagaggacctacagaagtccaaaatctcaaagagtggtcaataatatctcccccaattttgtcaccccaaaatgcatcttctgtaccacaagagtatcaatcatcaagatacacattgcatatggattctccagcattatcctctgcctcctcagcgctatctccactttcaggcgatccaataacaactacagaaacaaataagtcatacccattggattcagagcaatcgttgttggagccagacaaaaccgaggaggacgcaatcaatcagtcaaaggaaagcaatatgatttccattaatgagatgttacagaagcaaatggactttgaacttctgggtgagaatcatttgaaggagactcaagattatctggccctttacaaaaaagcttatgggatagaattttaa

SEQ ID NO: 110 - DNA, 1770 bp, Saccharomyces cerevisiae
atgactatttcttctgcacatccagaaacagaacccaagtggtggaaagaggccacaatttatcaaatttatcccgcaagtttcaaagactccaacaacgatggttggggtgatatgaagggtattgcctccaagttggagtacatcaaagagcttggtaccgatgccatttggatctcgccattttacgactcgccacaagatgatatgggttacgatattgccaactacgaaaaggtctggccaacctacggtacgaacgaggactgctttgccttgatcgaaaagacacataagcttggtatgaaatttatcaccgacttagtcatcaaccattgctccagcgaacatgaatggttcaaagagagcagatcctcaaaaaccaatccaaaacgtgactggttcttctggagacctcctaagggttatgacgccgaaggcaagccaattcctccaaacaattggaggtcttacttcggtggttctgcatggacgttcgatgaaaagacacaagagttttacttgcgtttgttttgctccacccaacctgatctaaactgggagaacgaagactgcagaaaggcaatctacgaaagtgccgttggatactggttagaccatggtgtagacggctttagaattgatgtgggaagcttgtactccaaggttgctggtctaccagacgctcctgtgattgacgaaaactcaaagtggcaactcagtgatcctttcacaatgaacggaccacgtatccatgagtttcatcaagaaatgaacaagttcatcagaaacagagtgaaggatggcagagaaattatgacagttggtgaaatgcgacatgctactgatgagaccaagaggttgtatacaagtgcgtcaagacacgaacttagtgagttattcaacttttcccacactgatgtcgggacttcgcccaagttccgtcaaaatttgataccatatgaactaaaggattggaaggttgcccttgctgaacttttcagatacgttaacggaactgattgttggtcaacaatttatctggaaaatcacgaccaacctcgttcaattaccagatttggtgacgattctcccaaaaaccgtgttatttctggtaagttgttgtctgtgttgttggtgtcactgagcggtactctatatgtgtaccaaggacaggaactgggtgaaatcaatttcaagaactggcctatcgaaaaatacgaggatgtcgaagttagaaataactatgatgcgatcaaggaagagcatggagaaaactcgaaggagatgaagaggtttttggaagcaattgcccttatttccagagaccatgctagaacacctatgcaatggtctcgtgaggagccaaatgctggtttttctggtcctaatgctaaaccatggttttacttgaacgagtctttcagggaaggaattaacgctgaagacgaatccaaggaccccaactcggttttgaacttctggaaggaggccttgagatttagaaaggcacacaaggatattactgtgtatggatatgattttgagtttattgatttggacaataagaaactgttcagcttcacaaagaaatacgacaacaaaacattgtttgctgctttgaacttcagctctgattcgatcgacttcacgattccaaacaatagctcatcgtttaagttggaattcggaaactacccaagaagtgaagttgatgcgtcttccagaacattgaagccatgggagggcagaatttacatatctgaatga

SEQ ID NO: 111 - DNA, 2115 bp, Saccharomyces cerevisiae
atgacggtcgaccatgatttcaatagcgaagatattttattccccatagaaagcatgagtagtatacaatacgtggagaataataacccaaataatattaacaacgatgttatcccgtattctctagatatcaaaaacactgtcttagatagtgcggatctcaatgacattcaaaatcaagaaacttcactgaatttggggcttcctccactatctttcgactctccactgcccgtaacggaaacgataccatccactaccgataacagcttgcatttgaaagctgatagcaacaaaaatcgcgatgcaagaactattgaaaatgatagtgaaattaagagtactaataatgctagtggctctggggcaaatcaatacacaactcttacttcaccttatcctatgaacgacattttgtacaacatgaacaatccgttacaatcaccgtcaccttcatcggtacctcaaaatccgactataaatcctcccataaatacagcaagtaacgaaactaatttatcgcctcaaacttcaaatggtaatgaaactcttatatctcctcgagcccaacaacatacgtccattaaagataatcgtctgtccttacctaatggtgctaattcgaatcttttcattgacactaacccaaacaatttgaacgaaaaactaagaaatcaattgaactcagatacaaattcatattctaactccatttctaattcaaactccaattctacgggtaatttaaattccagttattttaattcactgaacatagactccatgctagatgattacgtttctagtgatctcttattgaatgatgatgatgatgacactaatttatcacgccgaagatttagcgacgttataacaaaccaatttccgtcaatgacaaattcgaggaattctatttctcactctttggacctttggaaccatccgaaaattaatccaagcaatagaaatacaaatctcaatatcactactaattctacctcaagttccaatgcaagtccgaataccactactatgaacgcaaatgcagactcaaatattgctggcaacccgaaaaacaatgacgctaccatagacaatgagttgacacagattcttaacgaatataatatgaacttcaacgataatttgggcacatccacttctggcaagaacaaatctgcttgcccaagttcttttgatgccaatgctatgacaaagataaatccaagtcagcaattacagcaacagctaaaccgagttcaacacaagcagctcacctcgtcacataataacagtagcactaacatgaaatccttcaacagcgatctttattcaagaaggcaaagagcttctttacccataatcgatgattcactaagctacgacctggttaataagcaggatgaagaccccaagaacgatatgctgccgaattcaaatttgagttcatctcaacaatttatcaaaccgtctatgattctttcagacaatgcgtccgttattgcgaaagtggcgactacaggcttgagtaatgatatgccatttttgacagaggaaggtgaacaaaatgctaattctactccaaatttcgatctttccatcactcaaatgaatatggctccattatcgcctgcatcatcatcctccacgtctcttgcaacaaatcatttctatcaccatttcccacagcagggtcaccataccatgaactctaaaatcggttcttcccttcggaggcggaagtctgctgtgcctttgatgggtacggtgccgcttacaaatcaacaaaataatataagcagtagtagtgtcaactcaactggcaatggtgctggggttacgaaggaaagaaggccaagttacaggagaaaatcaatgacaccgtccagaagatcaagtgtcgtaatagaatcaacaaaggaactcgaggagaaaccgttccactgtcacatttgtcccaagagctttaagcgcagcgaacatttgaaaaggcatgtgagatctgttcactctaacgaacgaccatttgcttgtcacatatgcgataagaaatttagtagaagcgataatttgtcgcaacacatcaagactcataaaaaacatggagacatttaa

SEQ ID NO: 112 - DNA, 375 bp, Saccharomyces cerevisiae
atgatgggcgaaacacccaattccagtaaagtaccacggttggaggccagcatggcacgtagccagtacagagggtcggaagtctcactggacacgatcccgtacagcggaatctggcccagaatcaaaaagatcagtagagaaacgcctgtccagataagtttctggttgtatggaaccttcctttctggagcaatcacttccggcaggaaagattcaaatggcttaaacaagtctagaacacggttggaggacattttcaaagtaaagcgtgaaccagtgtcagtttttctacttgctactatatttaactatgtttttttcttttgctttcaccaactgaaccttgtagtaaatggagtgaggttgaattga

SEQ ID NO: 113 - DNA, 1098 bp, Saccharomyces cerevisiae
atggatttggtcttagaagtcgctgaccattatgtcttagacgacttgtacgctaaagttctgcccgcttcgttggcagctaatattcctgtcaagtggcagaaattgctagggttgaacagtgggttcagcaattctacgattttgcaggagactttgaactccaagaatgccgtcaaagaatgtagaaggttctacgggcaggtgccattcctgtttgatatgtcgacgacgtcttttgcatcgctattgcctcgttccagcatcttgagagaattcctctcactatgggttattgttacgatctttggtttactactttacttattcacggctagtctcagctacgtgtttgtgtttgacaagtcgattttcaaccatcctcgttacttgaaaaaccaaatggcaatggaaatcaagttggcagtcagtgctatcccatggatgtcgatgttgaccgttccatggtttgttatggaattgaacggccattctaaactatacatgaagattgattatgaaaaccacggtgtaaggaagctcattatcgagtacttcactttcatctttttcactgattgcggtgtgtatttagcgcacagatggttgcattggccaagggtctaccgtgctctgcacaagcctcatcacaagtggctggtctgcacacctttcgcatctcattctttccatcctgtagacgggtttttgcaatccatctcgtaccacatctacccattgattctgccattacacaaggtttcttatttgattctgttcacttttgttaacttttggactgttatgattcatgacggtcaatacctatcaaacaatcctgccgtcaacggtactgcctgccacacggttcaccatctatatttcaactacaactacggtcaattcaccactctgtgggacagactagggggttcttaccgtagaccagatgactcattgtttgatcctaagttaagagatgctaaggagacctgggacgctcaagttaaggaagttgaacatttcatcaaggaggtcgaaggtgatgataatgatagaatctatgaaaacgacccaaataccaagaagaacaactga

SEQ ID NO: 114 - DNA, 1659 bp, Saccharomyces cerevisiae
atgggtaaaattgcagagtttctcgggaatccaggtgctaggcctgacgttcatcatagagcacctactgttgactgcaaacagtacgaagaattcggtgattctaacgattacaaaaatgatgatgtggtcagagtagtcagccatagcgatgagagtactgatgacgaactttgtaatgtgaatttaacagaaacaggggcaatcttcacgagtaaaggttttaccgggttaagcaaaggtttcacagataagaccctggatttcctggtacgagtggccggttcgcaggcggttttttttattgtttggatcatcctcataatttgggtggttattggtattgtttataacgcacctttcaattggcaagttgttatgcaggacggacagtctattcaaagttatgtttgggacacactgttgatgagacaacagttgatgagtacgcatgaacaaattttgatctgcggtagattgaagtcgagattggcttccttcaaaaactatctaacaagaagcaccccagaggaagaaaaagcagactgcacagttgaagctaatgaagtcagctctgttgaaaatcatatagacccatctgccattaacggagaactgcctgtggaaaattggtacgaccgtttatctaacgtagcaagtaggtatatgggttcaattgcagcaatggtgatattttggataggtattttcgtttggattggttgcggtgctatcccaaaagatgcgggcaacactccaccttacaccggagaaactacaggtagtaatccaagattgaaaaagttcagtgacgcttggcagatgtatattaacactgcagttgcagtttcccttctaatttgcactactttcttacaaaatataagggctagacatgattatttcacggggaggtttttagttgatatctttgatatggacgagaaaatcgactatcgtataagaaagcattttaacgattttgaaacacctcacccagttgttactattgaatctaaaaaaaggtcgacagggagaaagatgattgattggtatgctgatattattggtactggtattggtgtcctgattggtgtggcagtgttcgccacatggattggtattggttcgccaatgaagtgggatgataattggtggttgattatcggtacatacacaggtttaattgggtttttggacggtttcgttttgagagaagtgtacttccgaatcgttcaacatgaagagaaaaattattctgatgtggctaaagaagaccttgaattattccaagaattaggtattgaatgtcccgaagaatttagtggtaaagctcctgaaattaacactattggttacagaacatcccaatatattaataggatctgctcaactccatggagtgttcttgtatccgtcatcatcatcattggtttaatttgtattgcttccggtttgcgttggagtacaacaggtcaattgattgctaacacgccaactatgattatcgaagaatttttcttgctagttttgttgcaagcacataattgggccgatcgtcaaagaagagtggaggttaccgctttgtacgcacgtaggcgcatacttctatcatacgtagaaaagcgtttcccagaggttatgatgttggaaaaatag

SEQ ID NO: 115 - DNA, 1722 bp, Saccharomyces cerevisiae
atggaaactattttgcagccaaaggctagaccatttgagtctttgaaaagaaaacgttttagagaatggttgaggccgtcgactgcgcatggatccctgttgcattctgatacattagatttgcgtgactttgcaaaacctaatcccgctgacacattttctaatcttgattctggtcattgtcctttggtcacaactccaataaaatatgagtgcccagatggaaagagttcttttttccgaggagacactaaatttgaaaccctgttcagtaatagaaaattctatgagttcaaagataatttgaaaaggggattgaagaaaatacgtcatgggagaaacggacatcaaagcgaaaagagatgtccagttgttgaagaaacaaaaaagtctgtgtcagataatctggacaaaccagacaataatacgccctgtttcgacagattccacacaaattcgaaagaatttgaaacgcaatttgatcattcaaataggagccaaaattccgagaaggcttatctagacaatgaatcctgttggaacctaagtgagaaatttattccttttaataatttaaaatatgaagatttgaaacattttgaagagaatttgcaaagcttagcgcctgcaacttttactccaattgaatcaaatgaatcgcttgataggtcagattcgacacgtggcacaaaacgaagcattcgcaatgattccagtgatacaacatctgaaaagaggctatgcttaaaacaatactcagatgaacctgaatcggatcattcgatggaaagtacaccatccatttacattaccaaagaagttcaagaaagaattgaagcattaagctccacggattcgtttttaattgaaaaagtagattttccctctaacaaaattggttccagtgcctccgattatgaaagtgataacgaatacagaaatatggatgaggattcaataaacgatgttaccactgagaaagagggaaatgtggtcataccagactctaatactagcacggtggacgcaatggaaaaaccaattgaagtgagctcggccttaaaagatgatacattggataaagacatagatgatgcgagcagtagctattcggatgatgtagagaccacattcgagccagttgaatctgaggaactttccgatttatctgatacaagctcaagtggaagtagtaaaatttatactatccccacatttcgcggccttactaataggaccaatatatcacaaattctttcaaaagttggtaaagctgatttaagccaagataacttaacgcatttgatcaaaagtcatcaaaaaaagaaaagatgcgtgaattttagaaataaaagattctatgatgctttcaatccatatgttgataacgaagaagatgcagagttatctgacagcgaaaacatttcagaaatggatacagatctttgtataaaggatcggagtacctcaagtgttaggtttgatgaaaactcacgtcttttaatctacaaaaaatctaaaaagttaaacaaagatgagactcaaagtggttattcgactactgaaatgaggtcaattctaaagacaaagatgaattcacagcatgatgaggagtctcagagagcttcgaagtgtgacacagtaggtgtagcccaatttttacattattttcaatatacagagtataaaaggcagagaaatgaagcagaaattatagactga

SEQ ID NO: 116 - DNA, 618 bp, Saccharomyces cerevisiae
atgtctccgccttgcaattgtaggctgttactcgggtttcttatcaagtggcgtgccacggcatctaccacatgtggctcagggttatttatgctcacttcaagcgtgccattgttacaggaagtgtgcgacgcgtcgggtacgctagcatgcaccgcttcattgttcacaagcagcggcggcttttttagcaaaccacctgtagttccactagattttctacttctgcttctacttctactattaccgttgctattgccaccgttgccgtccgttaaaggtgagccagacgcatgcgagattcctgtactgcctccgttgttattttttttgttgttgttgctctgcgttcttccagagccacttgaaacctcttttccattcatatccgcgatgcaatcccttatacgcttcttaataaactttgcttcccactctttcactactgaccatcgatccttcttatttcatagcctcacgagcacaaatgataatacgagaaaaaggcccgaccgggtaaccaacccttttactatctctcgctctacctttagtaataatgtcgtctatataaggatttactcatacagtagtccaaaatatacctttccgtgctaa

SEQ ID NO: 117 - DNA, 534 bp, Saccharomyces cerevisiae
atggcagaatacttggccacctgctccttccattcttccttcgtgaagcacttctttccatacgtaaagtctttcccaccattcttgccttggccgctgcaagatccgctcttcgtggtctcgttactaagagtagatatagtcatttctatttgttaccacacacaaatatatcttcatccggctgatatttgtctctactgcccctttgcttgcaatttaatgaccaaattacacatgttagcttcaagaaaaatgatgtaccatcaaaatgtctcctgcaacgaaccggggcaccgcgccggcagagtcaggaaagcgagatcgacactgatagtgataaacagcaacacaatggagcgattaccattcactcggaacggatccggacaacagtcaaataaactccgggatcccaaaaagggccgtacacacaaacccaagccgagcgaaaaacacaaaaaaaataaaacagggaaaaaaggagcgcaagagaaaacgcacaggagtaggagcagcagaaaggggaactaa

SEQ ID NO: 118 - DNA, 1833 bp, Saccharomyces cerevisiae
atgacggagactaaggatttgttgcaagacgaagagtttcttaagatccgcagactcaattccgcagaagccaacaaacggcattcggtcacgtacgataacgtgatcctgccacaggagtccatggaggtttcgccacggtcgtctaccacgtcgctggtggagccagtggagtcgactgaaggagtggagtcgactgaggcggaacgtgtggcagggaagcaggagcaggaggaggagtaccctgtggacgcccacatgcaaaagtacctttcacacctgaagagcaagtctcggtcgaggttccaccgaaaggatgctagcaagtatgtgtcgttttttggggacgtgagttttgatcctcgccccacgctcctggacagcgccatcaacgtgcccttccagacgactttcaaaggtccggtgctggagaaacagctcaaaaatttacagttgacaaagaccaagaccaaggccacggtgaagactacggtgaagactacggagaaaacggacaaggcagatgcccccccaggagaaaaactggagtcgaacttttcagggatctacgtgttcgcatggatgttcttgggctggatagccatcaggtgctgcacagattactatgcgtcgtacggcagtgcatggaataagctggaaatcgtgcagtacatgacaacggacttgttcacgatcgcaatgttggacttggcaatgttcctgtgcactttcttcgtggttttcgtgcactggctggtgaaaaagcggatcatcaactggaagtggactgggttcgttgcagtgagcatcttcgagttggctttcatccccgtgacgttccccatttacgtctactactttgatttcaactgggtcacgagaatcttcctgttcctgcactccgtggtgtttgttatgaagagccactcgtttgccttttacaacgggtatctttgggacataaagcaggaactcgagtactcttccaaacagttgcaaaaatacaaggaatctttgtccccagagacccgcgagattctgcaaaaaagttgcgacttttgccttttcgaattgaactaccagaccaaggataacgacttccccaacaacatcagttgcagcaatttcttcatgttctgtttgttccccgtcctcgtgtaccagatcaactacccaagaacgtcgcgcatcagatggaggtatgtgttggagaaggtgtgcgccatcattggcaccatcttcctcatgatggtcacggcacagttcttcatgcacccggtggccatgcgctgtatccagttccacaacacgcccaccttcggcggctggatccccgccacgcaagagtggttccacctgctcttcgacatgattccgggcttcactgttctgtacatgctcacgttttacatgatatgggacgctttattgaattgcgtggcggagttgaccaggtttgcggacagatatttctacggcgactggtggaattgcgtttcgtttgaagagtttagcagaatctggaacgtccccgttcacaaatttttactaagacacgtgtaccacagctccatgggcgcattgcatttgagcaagagccaagctacattatttacttttttcttgagtgccgtgttccacgaaatggccatgttcgccattttcagaagggttagaggatatctgttcatgttccaactgtcgcagtttgtgtggactgctttgagcaacaccaagtttctacgggcaagaccgcagttgtccaacgttgtcttttcgtttggtgtctgttcagggcccagtatcattatgacgttgtacctgaccttatga

SEQ ID NO: 119 - DNA, 3363 bp, Saccharomyces cerevisiae
atggttagtaggttttatcagattccaggtacgcatcggccatcgtcggcaatatcttcttcaaatgaatcttcttcactgttgtctgcaaggagaataagtcaaacatatttcaattatcaggcgacccctgaatgccaaaaagtttcctctaagtatgatcctgataacccaaacaaagataagttgggaacatacgatggggtatttgtgcctactgctttaaacgtattgtctatccttatgtttcttcgttttggcttcattttgggtcagttaggtattatatgcaccatcggtcttctgctattgagttacactattaatcttctcaccacgttaagtatatctgctatatctacaaacgggactgttaggggcgggggtgcttattatatgatttcaagaagtttaggacctgaatttggtggatccattgggcttgtctttttcttagggcaggtgttcaatgcaggtatgaacgcagtgggtattatcgaacctttactctataacttgggttattctgctcaaggcgagccacctgcagctttgggagagctactaccaagagggcattggcacgaatttacatatgccacggtcattcttttcttatgtttttctgtggcttttgttggctcgcaaacagtgtcaagagcagggaatattctttttttggtactggcagcttctatattttccattccactttctgcattgataagatcgccattcactgaaggcggtatcagttatacaggtccttcatggcaaacttttcatgataacctgctccctcacttaacaaaaggtgcagcaggttcgttactcaaaggtaaggaaacattcaatgatttatttggcgttttttttcctgctacagctggtatattcgcgggcgcaggaatgtcaagtgaattgagaaagccctctaaatcaattcctaagggtaccttatggggtttacttttcacttttatctgttatgccgttgttgtcttctccatgggttgttccattcccagaagatcgttatatgatgaagtacaaattatacagacgatcagttccgttcagtgggttatattcatgggtgaaatggctacttctcttttctccatcatagtggggatgctcggtgctgcttatgtattagaagcaattgcaaaggataacattattcctggtttggagatttttgctcattcaccgttatattcattgatttttacttggattctaacacagctatgtttgttttcagacgtcaataaaatcgccacatttatcacaatgacattcttaatgacgtttgtggtcatgaatttggcgtgcttcctattaggtatttcctctgctcccaatttcaggccctctttcaaatactttaacaggtatactacagcaattggcgcattactttctgttgttgcgatgttaatagttgatggcatctcagcgtctgtcttgtttttggctatgattttgctatttttattcattcattatttttcaccaccgaagtcttggggtgatgtgtctcaaagtttaatatatcatcaagtgagaaagtatttgcttcgcctacgtcaagacaatattaaatactggaggcctcaaatattgctgtttgtagataatccaaggacgagctggaacttaataaggttttgcaatcatttgaaaaaaggtggtttgtatattttaggccatgttgcagtaactgcggattttccgaagcaactaaatgaattaaaaactcagcagaaagcttggatgaagatcagagacatggcagcaataaaggcttttgtccaagttgggactggtccctcccttatatggggaattaggaatgtttttattggttccgggcttggaggtatgaaaccaaacattactgttgtcggtttttttgacctcgaaagttatagaaagcacatcccacaaagtcgcagccaaaataaccttcagaaacaggtggaaataaaagctacagtgccacgtagtacatgctctgatgtcaaaatcaatgttccattgcctacggatgagtgtaaaaatgaaaccaaagttaatgtacaacaatgggttcaaattgtagaagatctatcactgatgcaatccaatattgccatagcgcatggattcaaaaatttagagataccgaacaaaagggacagctgctttccaaaaaaaactatagatctttatcccatccaaatgtgcggaaaagttgaggcaaagggtgaccagcctgcggctatcactactaactttgatacgtatacactgattctacaattagctgccattttggttactgttcctgaatggaagcgcacacattcgcttcgagttattttatttgtggaacaagaatatcatagaacgaacgaaactcaacgaatgaaaaagctattacaggttctaagaattgacgcagaggttttggtagtatctttagatcaattcagagtatacaacacaattgtcaagggagacccaatcgtgtttgattatgtcaactcgaaattggccgataatgaatggtggaaagatttggttgaagctcgtgatacattaaaaccgaagcggaggttttccactattgaacctcaaacgatagcaaagcaatttacacaatcaagaaaatatacgtctggggttcagaaattgggtgtctcatttacaatgaatacgagaatgccaactaaccgcattgataccccatgcgagagtgaggactccgatttggatacagatcttacgtcaattcgtgatgccttctcggcatcgactaatatttcagtaggtaaggacttaacgaccaaatcgaagaccggttccgacagaacaaatttactcgtaaagaatttacaaagcgatgtgtcaacacagtcgttaagacccgttttctcgagtaatactttgccgaggacgagagtcgtggaagatggcacgggtgaacagccgacactgatcccaattgccgaacctgacctttcgaatgggaacggtactgggagcggtattggcaacggcaacaaattaaagaaaccggttcttcccgaattatcaccttgttgttcaaaagatagtttagtcacagcgatgcaaaatttaggtttcaatgatcttcccagcactgctcaacatttggttctgaatgatgtgatgacacaaatgtcaaagagttcggatttaattttttcaaccttgccagttccagctcttggaacacatgaagatcacgatgcaagtttacaatatgtcgaggacttggatatttggttggagggcttacctccatgcatgttaatcaattcgcaaaccatgacagtaactactgcattatag

SEQ ID NO: 120 - DNA, 543 bp, Saccharomyces cerevisiae
atgcattacaagaaagcatttctagcatctctattaagtagtattgcgctaactgcgtacgctccacctgaaccctgggcaactttaactccaagctctaaaatggatggtggcacaacagagtaccggacctcattcggtctcgctgttatacctttcaccgttactgaaagtaaggtcaaaagaaacgtcatttcacaaattaatgacggtcaagtgcaagtaacgacacaaaaattacctcatccagtttcgcaaattggagacggccaaatacaagttacaacgcagaaggtgcctccagtagtgtcacatattgtgtcacaaataggcgatggtcaattacaaataactacagctaaaaatgttgtcacaaagtccacaattgctgttccaagtaaaactgtaactgcgacagcaacttcaaccgcaactgctgtttctcagattcatgatggtcaagtgcaagttactatttcttcagccagtagtagttctgtgctttccaagagtaagttaagagccaacaaagaaaccaaataa

SEQ ID NO: 121 - DNA, 2808 bp, Saccharomyces cerevisiae
atgtctgcacatacttacaaaaagtttgaaaactcgacctcgggcgatttacctgataaaatgaccatttatcaggattgtatgaacacgtttaacgaatcacctgtcaattccaagagatgtcgtttattgatttctcgcttgctgagactcttggcccagggcgaaaccttcccacagaatgaagcaactgcattatttttctctatctccaaattatttcaacaccagaacgatcctttaaggcaggctgtttatttggcaatcaaggaattgagtggcatttcggaggatgtgttgatggcaacctcttcaatcatgaaggacgttcaaaacggttccgatttgattaagcctgacgctattagatcgctgacttatgtcttggatgaatctactgctttttccgctgaaaggttattaaaaagtgccgtggtaagtagacatccttcaatatcctcagcagcattatgtacttcttatcatttgctgcccatttcagaagtcactatcagaagattcaccaatgaaactcaagaagctgttttggatttgaaacaatttccaaatcaacacggtaatagcgaatattatccaaactccacttatatttctcaatatcatgctcttgggttgctttatcaactgaagaaaactgataaaatggcgttactaaaattggttagacatttctctgaaaacaattctatgaaaaatcaattggccaaggtagaattggtcaagattgtcaacgatttgatttatagggatcctcaattatttagtcaattcaggccacttttgtctgattggctatccaacaagttcgaatctgttcagttggaaacggcgaaattgattacttctttcgctactcgcaattcccgcttagtggctcccgagttatatgcggcagctatcagtgctttacagtccttactgaccgttcctcgtgtttcttctagattcgctgcattgagaatcttaaatagaatatccatggtttcaccagaaaagattgttgtttgtaatcctgaactagaatctttaattaatgattctaatagaaacatttctacttatgcaatcaccactttattgaagacaggaacttccaaaaatatttcatctctgatttcgactattactaattttatccatgatgtcagtgatgactttaagatcattattattgacgccgttcgtacgttgtctttgaacttcccacaggaatggaagtcaattttgaacttcttaatcgatgttttgaaaaatagtgaaggtggattcaaatttaaaaacagtattgtcgaagcattaatcgatattgtttcatttgttccacagtctaaagaactcgccttagaaaacttgtgtgatttcatcgaggattgtgaattcaacgaaatactagtgagaatactacatcttttgggtaaagaaggtccatctgccccaaatccatcattatatgttagacatatttataacagagtggtgttggaaaattctattattagatctgctgccgttgtagctttatctaagtttgctttgacgaagaacgatcctaccttatatgagtcaatcataagtttgttaaagagaatcgctaatgataaagacgatgaagtcagagacagagccaccattgcactagaattcattgattcggctaggaataaagatgatgttatagcacaaaatctaatcgaatccaaatatttttacgatattccatcattagagtcaaaattaagttcttacatttcctcaaatactgattcatttgcaactgcatttgatgtgaatcaagttcgtaagtttactgaggatgaaatgaaggcaataaatctgaagagaaagcaagaacaaattttcaatcaaaagtctgaaaccactttggatactacaccagaggcagagagtgttccagaaaaaagagctgacgctaattcatttgctggtccaaacttggacgaccaccaagaagatctactagctactaagtacgctgacgaattgctatccattgaacaaattaaaccatttggtcaattagtaaatagttctagggctatctcattaactgagccagaagcagaattcgttgtacgtggtgtcaaacatctcttcaaagacaatgttgttttacaatttaatattacgaatactctgacggatattgccctagacaatgtttctgtagtctgtacccctgaaatttctgatgaagctgaattagaagagctattcaccctacaagtggacagattattaccatccgaggaagcagcttgttacgttgcattcaaaaaacttgatgaaattgtaatggaaggtttcttgaacaacttaacattcactacaaaagaaataaaccctgacactaatgagccatttgatggtgatgaaggtttccaagatgaatatgaaattgactcgattttcttgaatgctggtgattatgttaagagttctttcactggtaacttctccgctacatttgatgagttgccatgcgaagaagttgctgttttcaacattcaagaagatttatccatacaagaagtagtagataagattattttgaacagtagctgcttaccggtggaaagtacccaatttgctccaagtgattcaaactcccacaccttgaaattatttggtaagagtgctttaactggatctaaagtagccctacagattaagatgatcaagagttcgaaaggtcttgctttgaaagttcatggtaaaggtgaagacagcttattatgctctgatctggtgaatggtctaatgcagtaa

SEQ ID NO: 122 - DNA, 381 bp, Saccharomyces cerevisiae
atgtcgccacaaacattttgcatcttgctcatattttcattatcattggaaaaaacatctctgattgtctggaatatctttgttaaccttcgtttgggtgttttcctcctgttagtacgaattttttcttcagttttcctatctgtcacctttctaggtctttttagaacgcttttacccgtaggacgcatctgctttcttctgctccttaaggcagatcgttttctcacttcatcaagggacccgtattctcgtttcctgccatcatctcgtattccaaaaaaatctttccacagtccctgtacggattttagcatattaccaatgtctattattgtacctttctcttcagagtatctacttgttcatgttcagcaataa

SEQ ID NO: 123 - DNA, 1527 bp, Saccharomyces cerevisiae
atgaaacttcaattggcggcagtggctacattagcagtcttaactagtccggcattcggtagagtacttcccgatgggaaatacgtcaagattcccttcacaaaaaaaaagaacggcgacaatggtgaactcagcaagagatcgaacggccatgaaaaatttgtactagctaacgagcaaagcttttattctgttgagctagccattggtacaccttcacaaaacctcactgtgctgttagacacaggctcagctgacttatgggttcctggcaagggaaacccctactgcggttctgtgatggactgtgaccagtatggcgtgttcgacaagaccaagtcgtccacgttcaaagccaacaagtcctcgcctttttatgccgcttacggtgacggaacctatgcagaaggtgcatttggtcaagataaattaaagtacaacgaattagacctcagtggtctatcgtttgccgtggccaacgaatctaactcaacctttggtgtgctcgggatcggcctttccacgcttgaagtcacctattctggaaaagtcgctattatggacaagagaagctacgagtatgataactttcccctgttcctaaaacattctggagccatcgatgcaaccgcatactctcttttcctaaatgacgagtcacagtcctccggcagcatcctcttcggcgctgtagatcacagcaagtacgagggccaactgtacactatcccgttggttaatctttataagtcgcagggttatcagcacccggtggcgttcgatgtcactttacagggcttaggactgcaaaccgacaagcgcaacatcacattgaccaccaccaagctcccagccctactcgattcaggcacaacgctaacatatctgccctcccaggcagtggctttgctagcaaagagcttgaatgcctcgtattccaagacattgggttattatgagtacacgtgtccctcgagcgacaacaaaaccagcgtggccttcgacttcggtggcttccgtatcaacgctcctctatccgactttactatgcagaccagtgtggggacctgtgtcttggcaataattccacaagcgggcaacgccaccgctatccttggtgattccttcttgagaaacgcctacgtggtctacgatttggataactacgagatttccctagctcaagccaagtatggcacggggaaagagaacgtcgaagtcatcaaatctaccgttcccagtgcaataagggcccccagttacaacaacacttggtctaactacgcctccgccacgtccggtggtaatatttttaccaccgtgcgcactttcaatggcaccagtactgccaccactacgaggtcaaccaccaccaagaagacaaactctaccactactgcaaagtcgactcataaaagcaagagggcactccagagggctgctaccaactccgcttccagtatacgctctaccttgggtttactgctagtcccctccttactcatcctttccgttttcttttcgtaa

SEQ ID NO: 124 - DNA, 2586 bp, Saccharomyces cerevisiae
atgtccaccgctgaatttgctcaactattggagaacagtatcttaagtcccgaccaaaacattcggttgactagtgaaacgcaattaaagaaattatctaatgacaacttcttacaatttgcaggtctttcttcgcaagtgcttatcgatgaaaatacaaagctagaagggcgtattctagcggcgctaactttgaagaacgagctggtgtccaaggactcagtcaagacgcagcaatttgcacaacgttggattacacaggttagtccagaagctaaaaaccaaattaaaactaacgcgctgaccgcattggtctccatagaaccgcgtatagcaaatgcagcagctcaattgattgcggctatagcagatattgagttgccccatggcgcatggccagagttgatgaaaattatggttgacaatacaggtgcggaacaaccagaaaatgtcaagagagcctctttattggccttgggttatatgtgtgaaagtgcagaccctcaaagtcaagccttagtttcttcatcaaacaatatcttaatcgctattgtccagggtgcgcaatctacggaaacttccaaagcagtcagactggcagctctgaatgctcttgcagactctttaattttcatcaaaaataacatggaacgcgaaggtgaaagaaactaccttatgcaagtcgtctgtgaagccactcaagctgaagatatagaagttcaagcagctgcctttggttgtttgtgtaaaatcatgtcactatactatacatttatgaaaccttacatggagcaagccctatatgcattgaccatagctacaatgaaatctccaaatgataaagtagcttccatgactgtggaattctggtccactatttgtgaagaagaaatcgatattgcctatgagctcgctcaatttcctcaatctcctttacagagttataatttcgctctctcttctattaaagatgttgtccccaatttgttgaaccttctaacgagacaaaatgaagatccagaagatgacgattggaatgtttccatgtccgcaggtgcatgcttgcagttgtttgcccaaaactgtggcaatcatatcttagaacctgtattggaatttgttgaacaaaatattaccgctgacaactggaggaatcgtgaagctgctgtaatggcctttggttccattatggatggccctgataaggtccaaagaacctattacgttcaccaagccttaccatctattttgaatttaatgaacgatcaatccctacaagttaaggaaaccactgcttggtgtattggtagaattgctgattctgttgctgaatctatcgacccacaacagcatcttccaggtgtcgttcaagcttgtttaattgggttgcaagatcacccaaaagtggccacaaactgttcttggaccattatcaacttagtcgaacaattagcagaagccacaccatctccaatctataacttctatcccgctcttgtagatggtttgatcggtgctgcaaatagaattgataatgagttcaatgcccgtgcatccgccttttcagccttgacaacaatggttgaatacgccacggacacggtagctgaaacttccgcctccatttctacgtttgttatggacaaattagggcagacaatgagtgttgatgaaaatcaattaacgttagaagatgcgcaaagtttgcaagaattgcagtcaaatatattgactgttctagcagccgttattagaaaaagtccaagtagtgtagaaccggttgcagatatgcttatgggactgttcttcaggttgttggaaaaaaaggactctgcgtttattgaagacgatgtgttttatgctatttcagctctagctgcttctttgggtaaaggatttgagaaatacctggaaacattttctccctatttattaaaggctttaaatcaagtagattcgccagtttcaatcaccgcagtgggcttcatcgctgatatttcaaattcgttagaagaagatttcagaagatattccgatgctatgatgaatgtcttggctcaaatgatctctaatccaaatgcaaggagagagttgaaaccagccgtcttgagcgtgttcggtgatattgcttccaatataggtgctgattttattccctacttgaatgacatcatggcgttgtgtgttgctgcccaaaacacgaagccggaaaacggcacattagaagcccttgattatcaaataaaagtactagaagcagtactagatgcttatgtgggtatagtagcgggtcttcatgataaacctgaagctctgttcccttatgttggtactatattccagttcattgcacaagttgcagaagatcctcagctgtacagtgaggatgctacctcaagagcagcagtcggattgattggtgatatagcagcgatgtttccagacggctcaatcaaacaattttatggacaagactgggttattgattacattaaaagaactaggagtggccaattgttcagtcaagccacaaaagatacagcaagatgggctagagagcaacagaagcgtcaattatccttataa

SEQ ID NO: 125 - DNA, 321 bp, Saccharomyces cerevisiae
atgatttcagtcaatttttcaccattgatctcttcttcgaacacccacatttgtactattggagcgaaaacttctgggtatcccttacaattttcggcaaccaccttggcaatagtagtaccccagttaccagatccaatcacagtaaccttgaaaggcttttcggcagccttcaaagaaacagaagaggaacttctctttctaccagcattcaagtggccggaagttaagtttaatctatcagcagcagcagacatctttatattatcaatatttgtgtttgtggagggggggggtgtacaatatacaattgtttcttga

SEQ ID NO: 126 - DNA, 1482 bp, Saccharomyces cerevisiae
atgctaccctatatggaccaagtactaagggcattttatcagagcacccattggagtacgcaaaatagctacgaggatataacggccacatcgagaacattattagatttccgaattccctcagcaatacacctgcaaatttccaacaaatctactcccaatacattcaattctttagatttttctacgaggtccaggataaatggttctctgagttatttatactccgatgcacagcaattggagaaattcatgcgcaactctactgatatcccattacaagatgccaccgaaacatacagacaattgcaaccaaacctcaatttcagtgttagtagtgcgaatacgttgagtagtgacaacaccacagtcgacaatgacaagaaattactacatgactcgaaatttgttaaaaaatccctttattatggtagaatgtactaccccagctctgatttagaagcaatgataataaaacgactaagtccacaaacccaatttatgcttaagggtgtcagtagtttcaaagaaagcttaaacgttttaacgtgctattttcaaagagattctcaccgcaatttacaggagtggatattttccaccagtgatctattatgtggttatagagtattacacaatttccttaccacgccttccaagtttaacacctcactgtacaataattcttcgttgtcgcttggtgctgaattttggttagggttagtaagtttaagccccggttgttcgacaactttaagatattacacacattctacaaacacaggacgaccactaactttgacattatcttggcaaccattattcggccatatatcctccacatattcggccaagacagggacaaattctactttttgcgcgaagtatgattttaatctttattcgattgaatcaaatctttcatttgggtgcgaattttggcaaaaaaagcatcatttgcttgaaaccaataaaaacaataatgataaattagaaccaatctccgacgaattggttgatataaatccaaacagcagagcgactaaactactgcacgaaaatgtaccggatctgaattcagctgttaacgatattccttctacactagatatacctgttcacaaacaaaagctattaaatgatttaacttatgcattctcgtcgtcattaagaaaaatcgatgaagaaagatctaccatcgaaaaatttgataacaaaataaatagttccatttttaccagtgtttggaaattaagcacgtcattacgtgacaagactttaaaactattatgggaaggcaaatggaggggatttttaatatctgccgggacagagctggtattcactagaggctttcaagaaagtttatccgatgatgaaaagaatgataatgcaatatctatatcagcaactgatacagaaaacggcaatataccagttttcccggcaaagtttggcatacaattccagtactccacatga

SEQ ID NO: 127 - DNA, 1017 bp, Saccharomyces cerevisiae
atgaaattatcaactgtcctattatctgccggtttagcctcgactactttggcccaattttccaacagtacatctgcttcttccaccgatgtcacttcctcctcttccatctccacttcctctggctcagtaactatcacatcttctgaagctccagaatccgacaacggtaccagcacagctgcaccaactgaaacctcaacagaggctccaaccactgctatcccaactaacggtacctctactgaagctccaaccactgctatcccaactaacggtacctctactgaagctccaactgatactactactgaagctccaaccaccgctcttccaactaacggtacttctactgaagctccaactgatactactactgaagctccaaccaccggtcttccaaccaacggtaccacttcagctttcccaccaactacatctttgccaccaagcaacactaccaccactcctccttacaacccatctactgactacaccactgactacactgtagtcactgaatatactacttactgtccagaaccaaccactttcaccacaaacggtaagacttacaccgtcactgaaccaaccacattgactatcactgactgtccatgcaccattgaaaagccaacaaccacatcaaccaccgaatacactgtagtcactgagtacactacttactgtccagaaccaaccactttcaccacaaacggtaagacttacaccgtcactgaaccaaccactttgactatcactgactgtccatgtactattgaaaagagcgaagcccctgagtcttctgtcccagttaccgaatctaagggcactaccaccaaagaaacaggtgttactaccaaacaaaccacagccaacccaagtctaaccgtctccacagtcgtcccagtttcatcctctgcttcttctcattccgttgtcatcaacagtaacggtgctaacgtcgtcgttccaggtgctttaggtttggctggtgttgctatgttattcttataa

SEQ ID NO: 128 - DNA, 1386 bp, Saccharomyces cerevisiae
atgatgatgttccataattgcagaattaataactacttaataacttctcaaattggcgaaggcgcgtacggtctggtttaccgtgccttagatattcgtaccgatagacaatacgctatcaaagcggttgttcaaagttacggtgttagcaaggaggctgatatgggcaatgataaaatacacaaaaatagcgtgaaattgcaaaagaagctcgctaaactgttcaaggaatcgaaaaacgttgtcagggtgccctctatagatctagaatcaattgagaatatgtcagaagaagattttaaaaagctgccccattataaagagatttcgctacacctaagagtccaccatcataagaacattgtcaccatacatgaggtgctacaatctgcagtctgcacgttcattgtcatggattattacccaacagacctattcacgtctattgtagataacagacattttgtcactaatggactgctagtaaaaaaggtttttctacagatctgttctgctcttaattattgccatgagcacggcatctaccactgtgacatcaagcctgaaaacttgctactggatacagaagataacgttttcctatgcgattttggtctatccactacttccacatatataaagccaaatgtttgcattggtagctcgtattatatgccccctgaaagaatctcatttgatgggagagtttccagctctaaaagtgggggacataagttgggtaaggtttgtccctcatgtaatggcgatttgtggtcattaggtatcatccttatcaatttgacatgcatcagaaatccctggctgaaggctgacaaaaccgaggataatacctactattatttcactaaggatcccaatatactaaagcaaatcctaccgctttccgatgacttttactcattattatctaagattttacaagtgaatccgaagaatagaatgagcttgcaagagttgatgaaagaagttagttctattacaagcttcaccaatgaaggcccgttatcaaaagtgccgcctctttccaagtctgtttatgaaaagttcgttagccccgtcgataacacgaatgagaatttgtctccaaaatcctacgtgtacatgcacgatagtaaagctgccaagaatttatcttatacatcttcaagtgaggaagaagatggaatcaaagaagggatagacgatgataatggcagtcgcagtggcagtttcggaacgctagacacagacactggattgcattcttcgttcacaagcacttcttgcgagtccgataacgaatgttctaagatttccaacaaattttccttgttcgaaaaaaaattcaacgaacttcgcatgagttcctcttctttaactaactaa

SEQ ID NO: 129 - DNA, 2280 bp, Saccharomyces cerevisiae
atgcctgcaccaaaactcacggagaaatttgcctcttccaagagcacacagaaaactacgaattacagttccatcgaggccaaaagcgtcaagacgtcggctgatcaggcatacatctaccaagagcctagcgctaccaagaagatactttactccatcgccacatggctgttgtacaacatcttccactgcttctttagagaaatcagaggccggggcagtttcaaggtaccgcaacagggaccggtgatctttgttgcggctccgcatgctaaccagttcgtcgaccctgtaatccttatgggcgaggtgaagaaatctgtcaacagacgtgtgtccttcttgattgcggagagctcattaaagcaaccccccatagggtttttggctagtttcttcatggccataggcgtggtaaggccgcaggataatttgaaaccggcagaaggtactatccgcgtagatccaacagactacaagagagttatcggccacgacacgcatttcttgactgattgtatgccaaagggtctcatcgggttacccaaatcaatgggatttggagaaatccagtccatagaaagtgacacgagtttgaccctaagaaaagagttcaaaatggccaaaccagagattaaaactgctttactcaccggcactacttataaatatgccgctaaagtcgaccaatcttgcgtttaccatagagtttttgagcatttggcccataacaactgcattgggatctttcctgaaggtgggtcccacgacagaacaaacttgttgcccctgaaagcaggtgtggcgattatggctcttggttgcatggataagcatcctgacgtcaatgttaagattgttccctgcggtatgaattatttccatccacataagttcaggtcgagagcggttgttgaattcggtgaccccattgaaataccgaaggaactagtcgccaagtaccacaacccggaaacgaacagagatgcagtgaaagaattattagataccatatcgaagggtttacaatccgttaccgttacatgttctgattatgaaactttgatggtggttcaaacgataagaagactatatatgacacaatttagcaccaagttaccgttgcccttgattgtggaaatgaacagaagaatggtcaaaggttacgaattctatagaaacgatcctaaaatagcggacttgaccaaagatataatggcatataatgccgccttgagacactataatcttcctgatcaccttgtggaggaggcaaaggtaaatttcgcaaaaaacctcggacttgttttttttagatccatcgggctctgcatcctcttttcgttagccatgccaggtatcattatgttctcacctgtcttcatattagccaagagaatttctcaagaaaaggcccgtaccgctttgtccaagtctacagttaaaataaaggctaacgatgtcattgccacgtggaaaatcttgattgggatgggatttgcgcccttgctttacatcttttggtccgttttaatcacttattacctcagacataaaccatggaataaaatatatgttttttccgggtcttacatctcgtgtgttatagtcacgtattccgccttaatcgtgggtgatattggtatggatggtttcaaatctttgagaccactggttttatctcttacatctccaaagggcttgcaaaagctacaaaaggatcgtagaaatctggcagaaagaataatcgaagttgtaaataactttggaagcgaattattccccgatttcgatagtgccgccctacgtgaagaattcgacgtcatcgatgaagaggaagaagatcgaaaaacctcagaattgaatcgcaggaaaatgctaagaaaacagaaaataaaaagacaagaaaaagattcgtcatcacctatcatcagccaacgtgacaaccacgatgcctatgaacaccataaccaagattccgatggcgtctcattggtcaatagtgacaattccctctctaacattccattattctcttctacttttcatcgtaagtcagagtcttccttagcttcgacatccgttgcaccttcttcttcctccgaatttgaggtagaaaacgaaatcttggaggaaaaaaatggattagcaagtaaaatcgcacaggccgtcttaaacaagagaattggtgaaaatactgccagggaagaggaagaggaagaagaagaggaagaagaagaagaggaagaagaagaagaagggaaagaaggagatgcgtag

SEQ ID NO: 130 - DNA, 1863 bp, Saccharomyces cerevisiae
atggttaaggaaactccattacactcatcttcatcaacttcgctgtcttcattatttaggccaactaagttgaagaatttatcggctaaaatattcaatggaggtggtaaccaatcatactcaaagacagatgatgtttcaaggtcttcttctagatcttcaaaaaagaatacagattctgaccaagaggatcaaataaagtataacaaacccaacgaccgaagatctaccataggaaagagcccccagggaaatggcgcgttgtcaaaggagtcacacgtagtagcaagttctactttgacaggtatttctcctacttcagctaaaaaagctcctattgactactctccttcacggcccttacctaacaatcataatcccgttcgtacgggacacactgtgccccacttaccccatagtattcacaatccaataaactacattcatcaaggctcaaaagatgctttccaccatcctcaccccgttcgctctacagctcatagcaacatttctacagtgtcttctgcaaaatctgatacaccctcttcgaatttatcataccaggcacatatgcatcccgtagagatactacagaaacagattgaagacaaacacttcatggactctcaagcctccacccctgggtccgtggaactacagcataattcttcaagcggtagtgatgatacctcatcaagaaagaaaaaatccttgagattaacaagatttttcaaaaaaattcataatgattatcacgataaccatcatcatcaccaccatcacaaccgtggatccacccctacaaaaccgaagctcaatttgaacaccaatgaaaatatagtagaaagtaacggaaaagcgttatacgaaacagataacccagtggagctattagaaaaatatggtattcctggtagaaaattaggcgaaggagcttccggttcagtgtccgtagtagaaagaacagacggcaagttatttgcttgcaaaatgttcagaaaaccacacttaaacaatgaaggaactaatcagtctcaattagctaattattctaagaaggttaccactgaattttgtattggttccacgctgcaccacgaaaatatcgttgaaaccctagatatgttgactgaaggtgacacctatttattagtaatggagtatgcgccatatgatttttttaatctcgtcatgagtaacctaatgacacaagatgaagtcaactgttacttcaagcagctgtgccacggcgttaattacctgcactctatgggcttagctcatagggatttaaaattggacaattgtgtcgtcactaaagatggcatcttgaaactgattgactttgggagcgctgtagtgttccaatacccttacgaagataccattgtaaaatcacatggaatcgtgggttctgacccttatttggctcctgagttattgaaacaaacatcctacgatccaagagtagcagatgtgtggtctatcgctattatattttactgtatggtccttaaaagatttccttggaaggctccaaaaaagagcttcaactcatttaggttatttactgaggaacctgaggacgaagatgatatagttcgggggccaaataaaatattaaggctactgccaagacattcacggacaataataggcagaatgttggctttagaaccaaagcaaagagttttaatgaatgacgtggtaaaggatgattggcttgtatccgtcccctcctgtgaagttgaccctacatctggcgatttggttgaaaaaccaaagaatcataagcatcacttggtcactgaggaggagttgaatgagctgaccaagcaacacgggaataaagattcaaattaa

SEQ ID NO: 131 - DNA, 1089 bp, Saccharomyces cerevisiae
atgagtcagcaaacaccacaggaaagtgaacagaccacagcgaaagaacaggaccttgatcaagagagcgtgttgagcaacattgacttcaatacggatttgaatcacaatttgaatttatcggaatactgtatatccagtgacgcaggaacagagaagatggatagcgacgaggagaagtcgttggccaatctgccggagttgaaatacgctcccaagctatccagcctggtgaagcaagagacgctcaccgagagcttgaaaagaccacacgaagatgagaaagaggcgatagatgaggccaagaagatgaaagtgccgggagagaacgaggacgaaagcaaggaagaggaaaagagtcaagaactggaagaggcaattgacagcaaggagaagagcaccgacgccagggacgagcaaggggacgaaggtgataatgaggaggaaaacaacgaggaggataatgaaaacgaaaacgagcatacagcaccgcctgcgctggtgatgccctcccccatcgaaatggaggaacagaggatgactgcgctgaaggaaatcaccgacatcgagtacaagttcgcgcaattgcgccaaaaactatatgacaatcaattggtgcggttgcaaacggagctgcagatgtgtctggaagggtcacacccggaattgcaggtctactactcgaagattgccgcgatccgtgactacaagctacaccgagcgtaccagcgacagaagtacgagctttcatgcatcaacacagaaacaatcgctaccaggacattcattcaccaggacttccacaagaaggtcaccgacctgcgagccaggctgctgaacagaaccacgcagacctggtacgatatcaacaaggagcgccgcgatatggatatagtcatcccagatgtcaattaccacgtccccatcaaacttgataacaagacgctgagctgtatcacgggctacgcagcgcacgacagctgtgctatcccggcgagcccgtggcagaggacctcgcttgcgaaagcatcgagtaccgctacagagccaacccggtggacaaactcgaagtcattgtggaccgaatga

SEQ ID NO: 132 - DNA, 984 bp, Saccharomyces cerevisiae
atggctattcaaaaggttagtaacaaggacttgtcccgcaaggacaaaagaagatttaatatcgaatctaaagttaataagatttatcaaaatttttactcagaaagagataatcaatataaagatagactgacagcattgcaaacggatttaacttctctgcatcaaggtgataatggccaatatgcccgccaagtacgagatttggaggaagaaagagatctagagttagtcaggttgcgcctgtttgaagagtaccgtgtttctcgttccggtatcgaatttcaagaagatattgaaaaggctaaggctgaacacgagaaactcattaaattatgcaaagaaagactgtattcgtctatagagcaaaaaataaagaaattacaggaggagaggttactaatggatgtggccaatgtgcactcctatgccatgaattatagcagaccgcaataccagaagaacacgagaagtcacacagtaagtggttgggattcttcgtccaacgaatatggaagagatacagcaaacgaaagtgctactgacacgggagctggaaacgatagaagaacgctaaggagaaggaatgcttctaaagacacgagaggtaacaacaacaatcaagatgaatctgattttcaaactggtaatggttctggaagtaatggccatggttctagacaagggtcgcaattcccccatttcaacaacctaacctacaagtcaggcatgaactctgactcagattttctacaaggtataaatgaaggtactgatctatatgcatttttgtttggcgaaaagaaccccaaagacaatgctaatgggaatgaaaagaaaaaaaaccgtggtgctcaacgatattccaccaaaacagctccacctttacagtctttgaaaccagatgaggtcacagaggatatttccttgatcagagaattaacaggtcagcctccggctcctttcagactaaggtctgactaa

SEQ ID NO: 133 - DNA, 996 bp, Saccharomyces cerevisiae
atgctgatgccaaagtcagttgcattactcagaataagatacactttggaagccgctctggcaagaggtttcacaacagtgagagactgtgggggtgcagaaggctttctgaaagcagagattcgtcagggatccttgaatggtcccagattaattacgtgtggacatgccatttcccaaactggtggtcatggcgatctgagatctggtgccctacctgctagtgcctttgacagctgttcatgccactttggtcaagttggtgttgtagcagatggtgttcccgaatgctacaaagcggccagagaagagtttagaagaggtgcagactttattaagattatgggtggtggaggtgtggcctctccaactgacaaaatatcaaacaaacaattttgcgacgacgaaataaaagcacttgtagatgtcgcaaatagttaccacacatacgtaacagcacacgcctacactgcggaagcgatacaaaattgtatcaagttaggtgttaagggtatcgaacacggaaacttattagatgaacgtaccgcagagcttatggcagaattgggttgctacttgactccaacactagttacctacaaagtgatgggttctgatcaatttagtgcattcttgggacctgaaaatagtagaaaaaatacagaggtgctttacaaaggaattgatgcaatgaaaattgcccagaaaaaaaaagttaaaatttgttttggttcagatttattgggtcctctatatggttatcaaacgcaagagtttcgtattagagggaaagttcaaacgacacaagagattttgctctcagcaactgttactcctgccgaaatgaacggattaggcgataaattgggacagattaagccagggttcattgctgacctactgatgatgaaatcaaatccgttggacgatataacgattttggatgaacccgagagcaacatactatttgtcatgaaagagggaaggatatattga

SEQ ID NO: 134 - DNA, 1215 bp, Saccharomyces cerevisiae
atgaccattattcagacggttactgaattgggtgttaccgaggacaccattaaggttcagatggctccttccggcggcaaacacctattggcagatcccggtaatcatccagcggagcattttgagagccagatgtcgtggctaaggtttcaaacaaggcagtatctaactagattcacagacaaccaatcagatttcgtacattctttacaaaaaaagcacagaacgccttttagagacgtttatttcaaatacacttcgcttatgggttcccacatgttttatgttatcgtgcttcccatgcctgtgtggcttggataccgcgatttaacacgggacatgatctacgttcttggttattcaatttatttgagtggctacttaaaggattattggtgcctaccaaggccaaaatcaccgccagttgacagaatcacactaagtgaatacactacgaaagaatatggtgcacccagttcacattctgctaacgctactgcggtaagtctattattcttttggagaatatgtttatctgacacactggtatggccaacaaagcttcttttactgagtctggtgatattttactacttaaccctggtttttggtagagtttactgcggtatgcatggtatgctggatttatttagcggcgccgcagttggagctatctgtttttttataagaatctgggtggtgcatgctttacgaaatttccagattggtgaacatctctggtttccccttttgagtgtagcatggggcttgtttattctgtttaaccacgtcaggcccattgatgaatgtccttgtttcgaagatagcgtagcgttcattggcgtagtcagtgggctggattgcagcgactggttaaccgaaagatacggatggaaccttgtatgtagtaggtacgcatcatgtggttctaaggtgttcttgaggcctctggtaggtgtcgcttctgtgattgtttggaaagacgtcattagcaagacagctgtctacacgctgttaattaaactactcagatttcacgatgatagaagcgaaaaggttcatttccataacgagacaagtgaagaagaagagtgtttattgtacagcggtgtttccaaagtggaaatcgtcggaaggtttctcatatacgcaggtatacctacaaccgtctttttgctatgcccagtttttttcacttggacaaacttaaggtag

SEQ ID NO: 135 - DNA, 429 bp, Saccharomyces cerevisiae
atggtgcagccagcacctctcattaccaatgcacctacaccgaaaatacccaacataccagctgttgcgctcaatgtagcaccttgcatcatggctcccataagtatagaccaactgcagggcaaatataacagccacgtgcccacgggtttctctagcctcatcagctccgcatacggtatccatttcttaggcagccgagacacgaacggtcccagtccatccaatctttcctttcttgcaacttccaactctttcgacgtaaacacaggtgctgattctttcgaggaaggggaggaggaggaggaggaagaagacgtatatctctttctgctgcttccaatgattccagcaacggtaactcggccgctgcccagaatggacctccctagtaaaatactctttctctgccaaataaacattagttga

SEQ ID NO: 136 - DNA, 1548 bp, Saccharomyces cerevisiae
atgtccaccctgattcctccaccttctaagaaacaaaagaaagaggctcaacttcccagagaagtagctattattccgaaagatttacccaatgtttcaatcaagttccaagctttagatactggtgacaatgtaggtggcgccctgagagttcccggtgctatctccgagaaacagttagaagaacttttaaatcaattgaacggtacttcagacgatccagtgccatataccttcagctgtacaattcaaggtaagaaggccagtgaccctgtgaagacgattgatataacagataacctatattcttcattaataaaaccaggctataacagtacagaagatcagatcacgctactgtatacgccaagagcagttttcaaagtcaagccggtaactagaagttcatcagccattgcaggtcacggttccacaattttgtgttctgccttcgcaccacatacgagttctaggatggtaaccggtgcaggtgataatactgcaaggatttgggactgtgacacccaaacgccaatgcatactctaaagggtcactacaattgggttctctgcgtttcctggtcccccgatggagaagtaattgctacgggatccatggacaataccataagattatgggacccaaaaagcggtcagtgtctaggtgatgctctcagaggtcattccaagtggatcacttctttaagttgggaacctatacatcttgtgaagccgggctccaaaccaagattagcttcatcttctaaggatggtactattaagatttgggacactgtgagcagagtttgccagtatacgatgagtggtcacacaaattcagtgtcttgtgtcaaatggggcggccaaggtctattgtatagtggctctcacgatagaaccgtacgtgtatgggacatcaattcgcagggcagatgtatcaacattttgaagtcgcatgcgcactgggttaatcacttatctttatctacagattacgcattgcgcattggtgcattcgatcatacaggtaagaagccttctacaccagaagaagcccagaaaaaggcattggaaaattatgaaaaaatctgtaaaaagaatggaaattcagaagaaatgatggttactgcaagcgatgattataccatgtttttatggaacccactaaaatctaccaagcctatagcaagaatgaccggtcaccaaaaattagtcaatcatgtggcgttcagccctgatggtaggtatattgtctcagcgtcttttgataactctatcaaactttgggacggtagagatggtaagtttatctccacatttagagggcatatagccagcgtataccaggttgcgtggtcatcggactgccgactactggtgtcatgttccaaagataccacgttgaaagtgtgggatgtaagaactagaaaactttctgttgacctccctggtcataaagacgaagtttataccgtcgactggagtgtcgacggtaaaagagtgtgtagtggtgggaaagacaagatggtaagattgtggacgcattga

SEQ ID NO: 137 - DNA, 1731 bp, Saccharomyces cerevisiae
atgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgtcactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaa

SEQ ID NO: 138 - DNA, 3570 bp, Saccharomyces cerevisiae
atgtacaagctacaagtggtcttggtgcctccgagtcttcaggcgacgatgccaatacagtttggctacggaccaaccatcgccgaatcttctcaattgttgccaaacagaactaatatggcgcaaagcgccggagatgcctctttgcagtatgctaatctgagatctgccaatgtgagtttcacgccaagctatttcaaccagtctaggtttaggaagtttcttttgtttaccaagccgacaaacacgctgttgaacttgagtgatgaaatcatcgataagtgtgaaaaaatgtacccgagtttgcaagaagacattgaaattttgagtttgcaagataacagcggttgtgaccttgatccggattttttggtaaaggacgttttcaatgtaaataatatcgtaagagttatattgaagaatgagatagatctggacgattccgcaccagtgtcactttataagtcggtaaaacgatccaagttgaacaacgggtcgccccagtcggtgcagccgcaacaacaaatcccgtcctcttcaggtgttcttcggattgccaagaagaggccacctacaggaaccacgacaacaacaaccattcgtagtgccactaatggatccatgagggtttctaccccattggctaggcaaatttatcctccaccttcttcgaagatcgtctccaacaactcagatgacgaagacgaagacattggtgaaagatcctttttgccgcctccaacgcagcctcagtcacctcccataagaattagttcgggcattgacgcaggtaaaaaaataaaatcaagcatcgtcgaggaagatatcgtgtccagatcagcaaccgtggatccagataaaacaaagcagcaacgtctattgtccggaactcctataatgtccaccatgactccaaacagagttactcttaccggtcagagagtggtttctgaacacgcacataaaaacgaattggttttctctgcttcagcttcttcctcttcatttgctaatggtggcacagctgctgtcactgctcaggacattaataggaaaccacccgtaaccactccaagaataacatcaggaatgttgaaaatccccgagccaagaatctcagagattgaaaaagagttaaaagagggaccttccagtccggcctccattttacccgctaaagctgcaaagattccaatgaaaaaaccttacttggaaaatggcgagaactacgaatccgacgatagctcaagtagcgaaaaccaagaaactcctgaaacagaaccacattcaaaggcttccttgcaacgtagtcaaagctccatcgcagataataatggctctccggtgaaaaatagtcctctcggtgatgccatgccacacaatgtgcatttagcagaacttcccaaggcaagcaatacctcgatcaccaaatcttcaaatggcgaatcctggggaaagcaacaagaacatcaaccaccaagaaagagttcactggaaactatagtggaaaagaaatctcaggcggaaccttccggtattgtggaaccgaaaagaatgactaatttcctagatgataatcaggtaagagaaaaagaagatacgaatgataaacttttagaaaaggaaattttgccgacaattccacataatgatcagccaatacttgcatcatctgataagtctaatgggacgttgaaatcactagctgggaaagttagttcaaacaacaacgcttcaaaggaagatggcactatcattaacggcaccattgaggacgatggcaatgataatgatgaagttgatactacggttcgtattgttcctcaagattcagattcctctagtttcccaaagtcagatcttttcaaaatgatcgaaggtgatgatacagatctaccgcaatggtttaagggcaaaaattcgagaacttccggtaattccaaaaattcaaagccttacacaacggttttgaataaagacatagacaattctaagccagatccaagaaatattttgccccagcgaaccccaagaagtgcggctaagagggctgcccaattattggcaggtgccaagaaaaacgaagtcccacagaaaagtactgaagattctagttcggcagcgtccacagacgatgagtcagagagtgggattgaaacagatttctcatcagacgatgattttaaaaggaaaaatatgtcggtgcctaataatgggcccaaagacatttctttacattctttgaaaggcagtgttgttccagtgaaagactcaaagataatcaataaagaagttgatgaagaaagaaacgacaaaagagatagtcaaaaaaagtcagccgtgagtgaatcttcagtaacaaatagcaaaataagtgaacaaatggcgaaaagcttttatccgaattcaaacaagaagcaaaatgaagctacaaaggtggaaactaagccagcaacacaagcatcgtcttttcctgttgttggtgggtctccttctgttgctactaaaggaactacctctttcaatgaagaaggaaatcgtaaaaatgttaaaacgaaggccaagaatgagtctgcgcagattgataggcagcagaaggaaacaacttctagggttgcagatttgaaaagcgcaaacataggaggtgaagacttgaacaagaaagcagaggggtccaaggaaccagaaaaagcatctgccaatatacaggatgctaacgataaaaataactcgaaggaaaaagaagactccaaaagcaaacaggtatctcagaaaaagttaaaaatgacagatcacttaaaagaaggcaatgttcagcttcctaagcccagtgcaaatgataaattgaaggatttgaaggctaaatttactaatagtaaaacactcgtgccacctggaataatttctaatgaaaaaaataattctagtgcaaacgatgatgattctagctcctcaggttcttccacagaagacgagtctagttcatcttcctcgtcttctgatgaggaaacttcaacatccaggaaggctagaagagttgttgtaaatacaccaagagaaccagttagatcttcatctaagattgaagccccctctccatctgttaacaaaaaaatcaatgccacccctgataaaattccagttacacagctaatggacatgtcgtctcctccgtcagttaaatccaagaccacctcaaatccgtctagtatacttcatgaccttccaagaaaagttcgtccttctttgagttcattatctgatcttgtttcaagaggcatcccagatgtaaaggaaaaaacttctaaatcgaatgagaagtcacaaacaaaagccccttcaagtagtgatgatgaatctagctctgattctgactctaactccagttcggactccgtatcggattccagttcagattctaaatctgagtcagattctgatgactcaggggattcatctgatgatggaaaaagttttattagtgcgaaatccgctagtgctgctttaggtaagaagaagaagccaagtggtggatttgcatcattaataaaagatttcaagaaaaaatga

SEQ ID NO: 139 - DNA, 2082 bp, Saccharomyces cerevisiae
atgtggggggatagtatgcgcgagcttggtgacgctatggataatgagttgaatgcagtgaagccggtggtggaagaaggtggcatggatggtgccagaaaatttattaagggtaagagctttcagaagtcttctaccgaacatatgttgatttcgcccggtagggatggttcagtgccattgaatgggttgaaatcgtcgccggcagacccgcacttgtctgatgttaattctatcttggacaatcatcgtggcggtggcgagacagctttgacgtctgtaaataatattatcatggccacttcgacgaatggggacagtgatggggttgatggagatgccaagaggccgtctatttctaactgttcgtcgagatcatcattttttgacaccgtactgagcacgttttccctaaaatcaaattcacaagatacggttactaatgaagtcaaaaatattgaggtccagtttgcatccgaggaggctaataaaaaattccgccaaatgttcaagccattagctcctaatacgagacttattacggactacttctgctacttccacagagaattcccctatcagggcagaatctatctctccaacacacatttatgtttcaactcaaccgtgttgaactggatggcaaagttacagattcccttgaatgaaattaaatatttagataaggtcaccacaaattcaagtgctatttcggtggaaaccgtgactaacaggtacactttttccggattcatagcgagagacgaggttttccaattgattacaagagtttggtcaaaggaaaacttaaccaatatcaatgacgttttggaggttgatgagagggtctccaagaaaaagggaatatcatcgaccccttcttccatattcaacaatgtttctaccaatgcatataacgatttcatatcgacaaccactactgaaccaacaagcagggcttcctacatgagcgagaacgacatgctcatcgaggaggccataaggtccgtggacgattacatgggcacaccaagagcatcgccatcttcttcatcttcgtcgtcatcgtcgtcatcgtctttaggctcttcaacaacttattattgtaggcccgtatataggttaaagccaaacgcaccatttcaatatgaggggccattccatgtacaagaaaccatggactttccttataaacctgaggctaataatgaatacgtgcttctggaacgtcaattcagcgttccacccggcctacttttcattatgatgttcaatgaagataatccagtttttgagttaagctttttgaaaactcaagattcgtccaacatctcacacatagggacttttgaaaaagtcaataaagatggacaacattacagagaattccaatacaccaaacagctgcatttccctgtggggcccaaatccacaaactgtgaggtagcggaaattcttttacactgcgactgggaaaggtacataaatgttttaagtataacaagaacaccaaatgttcctagtggtaccagtttcagcaccagaacgaggtacatgttccgatgggatgaccaggggcaaggttgcatattaaaaataagtttttgggtggactggaacgcatccagttggatcaagccaatggtagagagcaattgtaaaaatggacaaattagcgccactaaggacttggtaaagttagtcgaagaatttgtagagaaatacgtggaattgagcaaagaaaaagcagatacactcaagccgttgcccagtgttacatcttttggatcacctaggaaagtggcagcaccggagctgacgatggtacagccggagtcgaaaccagaagctgaggcggaaatctcagaaataggcagcgacagatggaggtttaactgggtgaacataataatcttggtgctcttggtgttaaatctgctgtatttaatgaagttgaacaagaagatggataagctgacgaacctcatgacccacaaggacgaagttgtagcgcacgcgactctattggacataccagccaaagtacaatggtcaagaccaagaaggggagacgtgttgtaa

SEQ ID NO: 140 - DNA, 4074 bp, Saccharomyces cerevisiae
atgaatgtatatgatgatgtgcttgacgctactgttgtgtctcattcattagcaacacattttactacttcagattatgaggagctcttagtggtgcgaacaaatatcctttctgtctacaggcctactagggatggtaaactgtatttgactgatgagtttaagtttcatggcttgatcaccgatataggcctcattccccaaaaagacagtccgttaagttgcctgcttttatgcacaggcgtcgctaaaatctctattttaaagttcaacacgctaacaaactcaatcgataccctaagcctgcattactacgaaggaaagttcaagggtaaatcgttggtagagctggccaaaatttccaccttgagaatggatcctggaagttcttgtgccttactgttcaataatgacattatcgcttttctacccttccatgtcaataaaaatgacgacgatgaggaggaagaagatgaggacgagaacatagacgatagtgaattaatccatagcatgaatcaaaaatcccaagggacgaatactttcaataagaggaagagaaccaagttaggtgacaagttcacggctccaagcgtggtattggtagcgagtgagttgtacgaaggcgccaaaaatatcatagatattcagttcttgaaaaattttactaaaccaacgatagcgctcttataccaaccaaagcttgtttgggcaggaaacaccaccatttcaaaactccctacacaatacgttatactcacattaaatatccagcctgcagaaagtgccaccaagattgaatcaaccacaatagcatttgtcaaggaactgccttgggatctacacaccattgtacctgtttcgaatggtgctatcattgtgggaaccaatgaactggcatttctagataatactggcgttttacaatcgacagtattattaaactcatttgctgataaagagttacagaaaacaaaaattatcaacaattcttcattggaaattatgttcagggagaaaaacactacgtcaatttggataccttcgtccaagagcaaaaacggaggaagtaataatgacgaaacactactacttatggacttgaaatccaatatatactatatccaaatggaagcagagggcaggttactgattaaattcgatattttcaagctacctatagtcaatgatcttttgaaggagaactccaatccaaaatgtataacacgtttgaatgccaccaattcaaacaaaaatatggacttatttattgggtttggttcaggaaatgctttggttctcagattgaataatttgaaatctaccattgaaacaagagaagcacacaatccatcttcaggtacaaatagtttgatggatatcaatgacgacgatgatgaggaaatggacgatttatacgccgatgaagctcctgaaaatggactaacaactaatgattccaaaggcactgtggaaactgttcaacctttcgatatcgaactgttatcatctctaaggaatgttggtcccatcacatcgttaactgtaggtaaggtatcttccattgatgatgtggtaaaaggactaccaaatccaaacaaaaacgagtattcgctagttgccacatcgggaaatggttcaggttctcatttgaccgtcatacagactagtgttcaaccggaaattgaattagcattgaaatttatcagtataacacaaatctggaatctgaagatcaaaggaagagataggtacttaataactactgattccacaaaatcccggagtgacatatatgaaagtgacaataacttcaaacttcataagggcggccgtttaagaagagatgctactacagtttacatttcaatgtttggtgaagaaaaaagaataatacaagtcaccaccaatcacttatatttatatgatacacattttagacgtctcaccacaattaaatttgactacgaagttattcatgtttccgtcatggatccgtatatactagttaccgtatcaaggggtgatattaagatatttgaattggaggaaaagaataaaagaaaattgttaaaagttgatttgccagaaattttgaatgaaatggttattacatctggtttgattttgaaaagcaatatgtgtaatgaatttttgattgggttgagtaagtctcaagaagaacagttattgtttacatttgttactgcagataaccaaattatcttttttactaaagaccataatgacagaatctttcaactaaatggtgttgaccaattaaatgaatctttatacattagcacttatcaactgggcgatgagatcgtccctgatccatcgattaaacaagtaatgataaacaaactgggccatgacaataaagaagaatacctgacaatattaaccttcggaggagagatttaccaatatagaaaattaccacaaagacgtagtagattttatagaaacgttacaagaaatgatctagctattactggtgctcctgacaatgcatacgccaagggtgttagttccatcgaaagaatcatgcattactttcccgattacaacggttattcggtaatatttgtaaccggtagcgttccatacatattaataaaagaagatgattccacaccgaagattttcaaattcggaaacataccattggtttcagtcactccctggagcgagcgttcagtcatgtgtgtagatgatattaaaaacgccagagtttacacactaactactgacaatatgtactatggtaacaaattaccattgaaacagataaagatcagcaatgtgcttgatgactacaaaactctgcaaaaactagtctatcatgaaagggctcaattgtttcttgtatcttattgcaagcgggttccttacgaagcattaggagaagatggcgaaaaagtaattggttatgacgagaatgttcctcatgcggaaggatttcaaagtggaattttactcattaatccaaaaagttggaaggtcattgataaaatcgactttccaaagaattctgtcgtcaatgaaatgagatcctctatgattcaaattaattcaaaaactaagaggaaaagagaatacattatagccggtgttgccaatgccaccactgaagacactccaccaactggcgctttccatatttatgatgtgatagaagttgttcccgaacctggtaaacctgataccaattataagctcaaggaaatttttcaagaagaggtcagtggtactgtatctactgtttgtgaggttagtggaagattcatgattagtcaaagccaaaaagttctagtaagagatatccaagaagataattccgtcataccagtggcatttttggatattcctgttttcgttacggattctaaaagctttggtaatcttttgataattggtgacgctatgcaggggttccaatttattggttttgacgcagaaccatacaggatgatttcattgggcagaagtatgtcgaaatttcaaacaatgtcgctagagtttttagtgaacggaggggatatgtattttgcggcaacagatgctgacagaaatgttcatgttttaaaatatgcgccagatgaacccaactctctttcgggtcaacgtttagtccactgctccagtttcacgttgcattccaccaatagttgtatgatgcttttaccaagaaacgaggaatttggctctcctcaagtgccatcgtttcaaaacgttggtggccaagtggatgggtcagtcttcaagatagttcctttaagtgaggaaaaatacagaagactttatgtgattcaacaacaaatcatcgatcgagaattacagctaggtggtttaaaccctcgcatggaaagattggccaacgacttttatcagatgggtcactctatgaggcctatgcttgatttcaacgttatacggaggttctgtggattagctattgatagacggaaaagcattgcgcagaaagcaggaagacatgcgcattttgaagcatggagagatatcataaatattgaattttcaatgagatctttatgccagggtaagtga

SEQ ID NO: 141 - DNA, 1884 bp, Saccharomyces cerevisiae
atgactctagaaccacactatagtgccaagtcggctgcttcagccagtgcctttgttgcccgttctgcgaccgaaagctcaacagcaagcacaaaagctgctcctaggaaaaagacgtactcgcagtcaaatggtattcccataaggattgataatctccctccgggcaagacttgggcccaggtaaaatatttgataggcggaatcatataccataccaatattttacaggtgaaaatgctgcctccaatgacttccatggttcctccttttattacttttcagagttgcattgtcattctgaagaactcgatagataacgagtccctggaaaacttactacttactttgaacacctaccaatgggattatcatgatctgttcgtttacctgttgccgtacactaatgattctccttcactgcgatatccagaaatcagtgatagcaacaatgacgtccggagtgctcccgatgaaactaaaagatctatttctcctcgatatgcaagccatgtttcatctgtgacaccgcagccaccatccgcttctaccccaccttctcaatttttcagtttttctcctgaagtgagccttcgaaagaatgagaacataacgccattgcccacgcctgttcccgtacctgttggtgtgccacctcttgctcccccgcctcatggtccattttcgacttcgatgctacctatgttgggtgctcctccgggaacggtacctaatatgcagatgccctatcaaactactctaccttcaccaacagctgctgctactgctggtggtccacttgcttcccctacacactatccccgtcgtcggcatttctatcaccagaaccaaagccagtttcaaaaatacatgcataatagccccaggaatccagatactggcacaggccctcgtctttctcagcagcatcacctctccttaaggaacaataagataaatccctcttataacgaaatatctgccctttacaacttgaacatggcctcaaattccaataataatggtaatattcccactacaagtacgaatggtgatgaccgtgccctccaagcaaagaatggtggaacaattacaccttcacaaactcaaataaatcacaaaagattaaagcatatctttaacgagaaaagctttagaaaacaaatgacgaatagaggtatgtggcagctgaagatcataaatttcccaccctatatacctatagaattcttggagaaattatcagagtctgatttcaatgagttaatgaaccaagagaagttcacagttattgaaattaaagagaaaggacaattggaaaaatttggaaggctaagatggacagttctaaaagattttataaaactgaaatgccccaagctattaagactacaggaaagacagtttctacagcaacaaaacgaagcatctttactcaatgaatctatggacgctctaaagatatcagaaaatgagaacaccaacgggagtgcaaataatagcacatacacaaatggcggacctcgaacatctatcaataatacaagggaattctatgtaggggtttatgaagatcatgaagaagcaactctactgaggtttgaattaccggaagatgaattagaggagtttaatagaaatttgccaactacttttgcacaaagtggaaacgtctctgactccgaaggtgatagcaaggcgaaatactttaaagttagcacaattgtgtataatgccattgttgggttccacgataaagagctgtctgatttgacgttcgaatccttacaagaccaggaatattcactggggtacaaaattcatgtaatggaactgccaccatttgacgaggatgaatttgaaaatcaacggcagcagttctaa

SEQ ID NO: 142 - DNA, 612 bp, Saccharomyces cerevisiae
atgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttgcatagctcatctacgtgtaggctgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcacgtggtttgtttgaagggattggtccgccctggaaatctggttcgtcttcaacaaacgtcaggaacttttttacatttttcccgaccatga

SEQ ID NO: 143 - DNA, 2682 bp, Saccharomyces cerevisiae
atggctggacaccatcacgaacatgaacaagagcgcgaccacgagcaagaacacgaacacgattcccttcaacggcctactactggatcagaaaggactagaagtatatccttttcgaagttgcttacgcggtcatggaaaaggaatgcgagttcatcgaacaacatgagtgtgtctagcgtgaatctgtattcggatccagagaactcgagagaatcagatcacaataatagtggctcagagggccagtcttcacgattttctaaattgaaaagtatgttccaatccggcaatagcagcaaaaatgccagtgcccataacagcagccaaagcagtcttgaaggtgactcggcgtcatcttcatctaagttaagatacgttaaaccaatgacttctgttgccaatgcttctccggcatctccaccactttctcccacgatcccggaaacggatgttcttcaaacaccaaagatggtacatatagatcaacatgaacatgagcgtgaacactcgaattgcgggtctccaataatgctttcatcatcctctttcagtcctactgttgccaggactgggacgggtaggagaagatcaccgtctactccgataatgcccagtcagaactcgaataactctagtagcacctctgctatcagaccaaataattatcgtcaccattcaggatctcaggggttttcttccaacaatccattcagagaaagggcaggtacggtacgcagtagtaacccatattttgcataccaaggtctaccaactcatgccatgtcttctcacgacctcgatgaaggattccaaccatatgcaaatggcagcggcattcactttttgtccacccccacctcgaagacaaattctttgacaaacaccaaaaatttaagtaatttatcactaaacgagattaaggaaaatgaagaagtgcaagaattcaataacgaggatttcttctttcacgatattccgaaagatttatcgctcaaagatacgctgaatggctcacccagtagaggtagttccaagagccccacgattactcaaacgttcccttcaatcattgtcggatttgacaatgagtacgaggaagataacaacaatgataaacatgatgaaaaggaagaacaacaaacgacaaccgacaataaaacgagaaatctttcacctaccaaacaaaatggtaaagctacccatccaaggataaaaatacctttaagaagagcagcttcagaaccaaacgggttgcaactcgcatctgccacatcgccgacatcttcttcagcaaggaaaacatcagggtccagtaatataaacgacaaaatcccaggccaatcagtgcctcctccaaactcatttttccctcaagaaccctctccaaagatttctgattttccagaacctaggaggtcccgacgtttgagaactaaatctttcagcaataaatttcaagatatcatggtgggaccacagtcttttgagaaaataagattgctgggccaaggtgatgtaggtaaagttttcttagtaagagagaaaaagacgaatagagtgtatgctttgaaagtcttgagtaaagacgaaatgataaaaagaaataaaatcaaacgtgttctgacagaacaagagattcttgccaccagcaatcatcccttcatcgtcacactataccattcgttccaatctgaagactatttgtatctctgtatggaatactgtatgggcggggagtttttcagagctttacaaacaaggaaaaccaaatgtatatgtgaagacgatgccaggttttatgccagtgaagtgacagcagcactagaatatttacatctgttgggttttatctatagagatttaaaaccagagaatattttgctgcatcaatcaggccatatcatgctttctgacttcgacttgtctattcaggctaaagattccaaggttcctgttgtcaagggttccgctcaatcaacccttgttgataccaaaatatgctcagatgggtttagaaccaattcctttgtcggaactgaagaatatattgcccctgaagtcataagaggtaatggccacaccgctgcggtcgattggtggacgctagggattttgatctatgaaatgttatttggtttcactccattcaaaggcgataacacaaatgaaacttttacgaatattttgaaaaatgaggtcagttttcccaataacaatgaaatctccagaacttgtaaggatttgatcaaaaaattactgacaaaaaatgaatctaaaagactgggttgcaaaatgggcgctgccgacgtgaagaaacacccctttttcaagaaagtccaatggtctttgctgagaaatcaagaaccgcctctgataccagtgttatctgaggatggatatgattttgctaaattatcatctaataagaagagacagactagtcaagacagccataaacatctcgatgagcaagagaaaaatatgtttgaagaacgagttgaatacgacgatgaagtctctgaagatgatccattccatgacttcaattcaatgagtttgatggaacaggataacaattcaatgatttatggtaataccaattcttatgggaaaattgcatacactccaaactccaacagatcgaggagtaatagtcatcgaaccttttttaagagataa

SEQ ID NO: 144 - DNA, 582 bp, Saccharomyces cerevisiae
atgtcgtttactgctccttcagatcccgtcaataaaccgacaaaagtgaaggtatcacagttgtgtgaactatgtcattcaagaaaggctctcattagaagacccaaaaacctgtctaaactttgcaaacaatgcttctgcctcgtgttcgagacggagatccataacactattgtagcaaataacttgtttcagaggggagaaaaagtagccgtgggggcctctggtggtaaagactccacggtgttagcgcatatgctgaagcttctgaatgaccgttacgattacggcattgagattgtactgttgagtattgacgaaggaatcatcggatacagagatgattccttggccacggtgaaaaggaatcagcagcagtatggccttcctttggagattttttcctttaaggacctctatgattggacaatggatgagattgtatccgttgctggtataaggaacagttgcacgtattgtggtgtttttagaagacaatcattggaccgtggtgctgcaaagtgggcatatctcacgttgtcaccggccacaatgcagacgatatggcagagacagtactaa

SEQ ID NO: 145 - DNA, 1422 bp, Saccharomyces cerevisiae
atggcaaaggataatagtgagaagctgcaggtgcagggagaggagaaaaagtccaagcaaccggttaatttcctgcctcagggtaaatggctgaagccaaatgaaatcgaatatgagtttggtgggactactggtgttattggtatgctgatcgggtttccactgctaatgtactatatgtggatttgtgcggaattttatcacggtaaggttgccctacccaaggctggtgaatcgtggatgcactttatcaagcacctataccagttagtcttggagaacggtatcccagaaaagtatgactggactattttcttaacattttgggtgtttcagatcattttctactatacgttgcccgggatttggacaaaaggtcaaccattgtctcatttgaagggaaaacaattgccttacttttgtaatgccatgtggaccttgtatgtaactaccactttggtcttggttttgcactttaccaatctttttagattgtatgtcattattgaccgttttgggaggatcatgacatgtgccattatttcagggtttgccttctccatcatattgtacttatggactttatttatctcacatgactatcatagaatgacaggaaaccatctatatgatttcttcatgggagctccactaaaccctaggtgggggattttggacttgaagatgtttttcgaggttagattaccttggttcaccctttactttatcactttgggtgcctgtttgaagcagtgggagacttacggctatgtgacaccacaattgggggttgtcatgttagctcattggttgtacgcgaacgcatgtgctaaaggtgaagaattgattgttccaacctgggacatggcttacgaaaagtttggatttatgctgatcttctggaatattgccggtgtcccatacacttactgtcattgtacgttgtatttgtactaccatgacccatctgaatatcactggtctacactgtacaatgtttcgctgtacgttgttctattatgcgcctactacttctttgacacggcaaatgctcagaaaaatgccttcagaaagcaaatgtctggtgacaagacaggtaggaagactttcccatttttgccataccaaattttgaagaatccaaagtatatggttacctccaatggatcgtacctattgattgatggttggtacactttggctagaaaaattcactacactgccgattggactcaatctctcgtttgggccttgtcttgcgggttcaactcggtgttcccatggtttttcccagtattcttccttgttgtcctgattcacagagccttcagagaccaagcaaaatgtaagagaaagtacggaaaagattgggatgagtattgtaaacattgcccttacgtctttattccttatgttttctag

SEQ ID NO: 146 - DNA, 4104 bp, Saccharomyces cerevisiae
atggagaaagacctgtcgtctctttactctgaaaagaaagacaaagagaacgatgaaaccttatttaacatcaaactatccaaatctgttgtcgagaccacaccgctaaatggtcattcattgtttgatgatgataaatcactttcagactggacggataatgtgttcactcaatcagtattctatcacgggtcagatgacttgatatgggggaagttctttgtctgcgtgtacaagtcccccaacagcaataagttgaacgctataatattcgacaaattaggaacatcatgcttcgaatccgtcgatatatcttccaactcgcaatactatccggccattgagaatttgagtccaagtgatcaggaaagcaatgttaagaaatgcattgctgtcattctgttacagcgctatccattactttcaccatcagacttatcacaaatattgtccaataaatcggaaaattgcgactatgaccccccttatgctggagatttggctagtagttgccagttgataacagcagttcctccagaagatctggggaagcgcttctttacatcaggacttctgcaaaatagatttgtcagctctaccctgttagatgttatttatgaaaacaatgaatccaccatcgaactaaataataggttggtattccatctgggtgaacaacttgaacaactttttaacccagtcacagaatactcaccggaacagacagaatatggttataaggcgccagaggacgaattacccacagaatcggatgatgatcttgtcaaggccatttgcaacgagttattacaactacaaacaaattttactttcaatttggtagaatttttgccaaaattcctgatcgccttgagagtcagagtactcaatgaagaaattaatgggttatccacaaccaaattaaatcgactcttcccacctacaatagatgaagtcacaagaatcaattgtatttttctagactcgctaaagacagcaatcccttacggttccctcgaagtactgaaggcatgcagcattactattccttatttctacaaagcatatacaagacacgaggcggccacaaagaacttcagcaaagatattaaattgtttattaggcatttcagcaatgtaattccagaaagagaggtctacacggaaatgaaaatcgagagtataattaagggacctcaggaaaaactactgaagctaaacttaattatagagagattgtggaagtcgaaaaaatggagaccgaaaaatcaagaaatggcaaaaaaatgctacaacaatatcattgatgtcattgattcgtttggaaaattagattccccacttcattcttatagtaccagagtatttactccatcgggaaaaatccttacagaattagccaaatgctggcccgtagaactgcaatacaaatggctgaagagaagggtagtcggtgtgtatgatgtagtggatttgaatgatgaaaataagagaaatttattagtcatattcagtgattatgtggttttcatcaatatactggaggcagaaagttactacacttcagatggatcaaacaggcccttaatctcagatattttaatgaactcattgatcaacgaagttccgttgccctccaagatccctaagttgaaagtggagcgtcattgctatatagatgaggttctagtttctatattagacaaaagcactctacgttttgatcgattgaagggaaaagattctttctcaatggtatgtaaattatcctctgcatttatctcttcttcgtcagttgctgacttgattacgaaggctagaattttggaaaaagacactgcatttcatttatttaaagctagtagaagccattttacattatattctactgctcacgagctttgcgcttatgattccgaaaaaataaaatcaaaatttgccttattcctgaacataccaccatccaaggagatattggaggtcaacaaccttcatttggctttttttgcaagattttgcagtaacgatggtagagataacatcgtaatcttagacgtcttaaccaaacatgacgataaacatatagaagttacatccgataacattgttttcaccataattaatcaattggccattgaaataccgatatgcttttcttccttaaactcatcgatggccaaagatttactctgtgtaaatgagaatttgataaaaaacttagaacatcaattggaagaggtcaagcacccttcaacagacgaacatagggctgttaatagcaaactttccggtgcatccgatttcgatgctactcacgagaagaaaagatcatacggtaccataacaacatttagaagctatacaagcgacttgaaggacagtccatcaggcgataatagtaatgtcaccaaggaaactaaggaaattttaccagtgaaacctacgaaaaagtcttcaaaaaaaccaagagaaattcaaaagaagaccaagacaaacgcctctaaagcagagcacatagaaaagaagaagcctaacaaaggcaaagggttttttggcgtgttaaaaaatgtttttggaagtaaaagcaagagcaagccttcaccagttcaaagagtgcctaaaaaaatatcgcagaggcatcctaagtctccagtgaagaagccaatgacctcagaaaagaaatcctcccctaaaagggcagtcgtttcatctcccaaaattaaaaagaaaagtacttctttttccacaaaagaatcacaaactgctaaatcttctcttcgagcagttgaattcaaatctgatgacttgatcggaaaaccacctgatgttggaaatggcgcacatcctcaagaaaataccagaatatcttcagtagtaagggatacaaaatatgtctcctacaatccctctcagcctgtgacagaaaataccagtaacgaaaaaaatgtcgaaccaaaagcggatcaatccacaaagcaggataacatttccaattttgcagatgtagaggtatctgcgtcttcttatcctgaaaaacttgatgcagaaacagatgatcaaataattgggaaggcgacgaattcgtcatcagttcatggaaataaagagctgccagaccttgctgaggtgactacagcaaatagggtttctacaacatcggctggggaccaacgtattgatacccaaagcgaatttttacgtgcagctgatgttgaaaacttaagtgatgacgatgaacacagacagaatgaaagtagagtttttaacgatgacctctttggtgattttattcctaagcattaccgtaataaacaggagaacattaacagctcgagtaatttgtttccagagggaaaggtgccccaagaaaagggcgtatcaaatgaaaacactaacatatctctcaaaactaatgaagatgcatctacattgacgcagaaactctctccacaagcgagtaaagtgctgacagaaaattctaatgaattaaaagataccaacaatgaagggaaggacgcaaaggacataaaattaggagatgattacagtgataaagaaacagcgaaagaaataactaaaccaaaaaattttgttgaaggaataactgaacggaaagaaatattccccactattcctaggttagcgccgccagcttcaaaaattaactttcaaaggtcaccatcctatattgagctctttcaaggaatgagggtggttttagataagcatgatgcccattataactggaaacgcttggctagtcaagtctccttaagtgagggactaaaagtcaatactgaggaagatgcggcaattataaataaaagtcaggatgatgccaaggcggaaagaatgactcaaatttctgaagtgattgagtatgaaatgcagcaacctatcccaacttatttgcctaaggcgcatctagatgactcgggtattgaaaaaagtgatgacaaattcttcgaaattgaagaagaacttaaggaagaattgaagggcagcaaaacggtaatgaagatgtcggtaataataatccatccaattctattccaaaaatcgagaagcccccagcattcaaagttattagaacatcgcctgtga

SEQ ID NO: 147 - DNA, 567 bp, Saccharomyces cerevisiae
atgaatcctcaagtcagtaacatcatcatcatgttggtcatgatgcaactctcccgtcgcattgacatggaggacccaaccatcatcatgtacattagaattttatactgttcttccatcggtatctcttggatcatctaccaaatggccagaaagagaattgttgctaaaaacgacatgactaccatgaagtacgtcgaacctggtaatgctatgtccggcgaaggtgagaagctgcaagttactaccgtcagagactacgatttgaaggaaatagacagtgctatcaagtctatctacactggtatggctatgatgggtttcatgcatttgtacttgaaatacaccaacccattgttcatgcaatccatttctccagtgaaaagcgctttggaacacaacgaagtgaaaattcacctcttcggtaagcctgcaaccggcgatttgaagagaccattcaaggctccatctttgtttggtggtatgggtcaaactggtccaaagaccgacaagaaatctatcgaagaagctgaaagagccggtaacgctggtgttaaggctgaatga

SEQ ID NO: 148 - DNA, 435 bp, Saccharomyces cerevisiae
atgaatattctttttctcatatatctgaaagacaaaagatcggcacggcaatgccctgcagcatttcttcctagtttttccgaatttccattacgtattggatcttgtgcgcatatttgtcagtccttcacggaaaaaaaaaaagagcactgggtcacttcggaaaaacttttgactcaatgcaacagtgtcataatcctttgcgctgtctctttgaagaaaaatcaggagtgcaagatatcgattaattccttggaagttatgatggttagtcttagtttaactctcttgaagaagggttttttcagttggtcaacactctttagaggtaaaaaaaaaaaaaaaaaaaaaaaaaagagaattcttcatgtaatttaccatgattctacgtttttgcaagcaaaaatgaagataatccgagcgcatgcgaagtag

SEQ ID NO: 149 - DNA, 351 bp, Saccharomyces cerevisiae
atggggaaatattcatcatgtagaatttcaaatattttcattgtaatttctaaaattaatgaggaaaattcgatatatctggtatcactttattattccttcagcacgaaatgtcgagcgatctcgatgcaggaaccaggtataagtagcgatagtaaatttttttctctctttttaataatccggaaagtctcagttgcgagtgattgcagacagttgtatgaatgtaaaaaaagtaatgaaaacatttgggagtatttcaaacggaggttagagacgaggctttcgagcttttctattattttaagtgctgtgtttccggacgtgctcttcactttcttattttcttga

SEQ ID NO: 150 - DNA, 642 bp, Saccharomyces cerevisiae
atgggacttatttcatacgaaaatgaggcgataaacgaggtgaaaaaggcagataaccatcacgttagcaaatttgtgactagttactatgggccatcatcgtcgtcatggcagtcaggaatatggattttgtttgtgctgtttgttgccgcagtaatccttataatactgttcacttttgtagcgaacagaaggagacgaaggatggggcgtgctcccattagaggtacggcatggttgacaccgccttcatacagacagtctcagcaacaatatactgggaccgttcagcaacggacagatgattatgttcctgagtatacagaaacagcgaacgaacatgatcttggatactatgaccagcggggcgagtttcaccccaacgataaggctgcatacgtggcccccccgccattggtacaagaatgttcatcagaatctgttaattctttagaaagacctcccgctgctgtagttcaccaagctaactctttagatacggattacggtttaacaaggcctagcaatgggcgcgttccagctgtaagtgatacggtggagcaattggaaaggcttccgggcgggactacaacgcaggaaattaacccaccggagagggcaaaggtaaatgcaaggtcatga

SEQ ID NO: 151 - DNA, 3042 bp, Saccharomyces cerevisiae
atgaaggacttgtctcattatggtcctgcgctatgtgttaaattttacaatgattatgttctagctggttatgggcctttcatccatgtctatgactatcattcggctacgttgattaacaaatgtaggctatttcactacaataaagttcatggacttagcctttctagtgaagggaaaattttggcctatggtgcaagatcagtaacaatagtggaacttgaagacgttttaaagaaagagtcattggtggatttcgaaaggattaactcagattggattaccggtgctacattcagctttgacaacttgcaaatatatttgttaacatgttataataaagtgctaatttgtgatttaaattgtgaagttctttttaggaagtctcttgggggagaaagatctattctatattccggtataattaaagttttcggtccggataaagtatatgttaacgctggtactgtaatgggcggtgttatcatttgggacctgttctcggagacaaaaattcataacttactgggtcatgaaggttctatcttttatgttaatttaagcaacaacggaagatatgttgccagttgctctgacgacagatcaattagactgtgggatttagaaactggcaagcagctgtctgttggctggagccatacggcaagaatatggaatttaatgttttttgataatgattcaaaactaataagtgtttctgaagattgcacatgccgtgtatggaacattatcgaatcacgagaaaacgttgccgaattatccatatctaacgtttacgaagtacatttaatcaagagtatatggggcgttgatgtgaaagacgacgaaatgatagctgtaacctccgggaatgatggtaggttaaagctgattgatcttcttcaactgaagagacacggcgatgaagaaacatcgttcagtctagatgatatcgcaaagcaatgtggcgatattttcgaaaagaatgaaagtatcaagggatttcaatggttttcattcggtgtaattgctatcacttcattgggtaaaatacttaaatacagtgatgtcacgaaacaatggaagttgttactaacaaatgaaaaattcaactcgtatccaattacaaatgggattcaaacgcaaaatatcgctgtcttttccaataataaaagtgacatccttcttatcaaatttagcaaagatagcgctgacataattgagaccgaagaattccatttagatgagctttctaagacaaataactgtctcgttacagaatacgatgatgactccttcctattgactttacaatccccaaatcctcgagagaagtttgtatgtttggaaataagccttcagaacttaaaaattaaaagcaagcactgtttcaataagccggaaaatttttcttcctcatgtttgacctccttccgaaatcatattttagtcggctcacgttttagtacattagtaatctacaacttacttgatgagagcgaggagcccttcataattaggagattaagtcccggagacactacaacctcaatcgaatttgtagaagataaagacaactctgcggtcttctcagtaacaaatagggatggctattatgtatttattgagttgacgaaaaacagtttggaagagggtccctaccgactaagttataaggtcttgcattctaataagatgatgaaaggtttcttggagggcgctttctttaattcaaaaggtgaatacattacttatgggttcaagtccagcttgttttatctctacaatgaaaccaactgttatgaactagctagtgaagtttgtggtggttcccatcgtctgtggaatctcgcaaaaattactgatggccacgtattaatgtatattaaggcatcccgatttcatttaaggaaaatttacaactccattgtgcctgaaactttagaaaatggtgtacacggaagggaaatcagagatatttcaatctgtcctgtttcaaataccaacacgaatgacaattttaaggatgggcatatattctgtactgcatctgaagatactacaattaagctgggatattttaacaatagaacagggaaggtgcagaatttttggacacaaagaaagcatgtgtctggattacaacgttgtcagtttataaatcacaaactaatgatatcatcttcagctagagaggagttattcttatgggaattgaacgataagtataataaacgaccatatatgaccatacgacaagctttacctgtatccacaaataattctgatctaaggatcatggattttgatgtcaaatttatatcacagtcaggtgacttcttattagttactgtttattcagattcaacaataaagatttggcactatagggaaaatcagaataagtttgacctgatcatgcaaggtcgttataagacgtgctgtttattcaacgtcgtatttattgcactgaaagaagagctccttgttgtcatttcaccaactgatggacatttagtggtttataatataaccgagtacgtaccattttccgttgatccgatttctggcgatttggttgaccacaaactggacgctactatctcaaatcttcccgcacctgtagcgcagttgccggtacatcaatctggtgtcaagtccctagactatgttgctaatgctacaagaacttccgccacaattttgacagggggtgatgataatggtttagggttaagcaacctgaaattagatgactcgaataaagtaacgttaaaaacaagtgactttatcgctgcagcagcttcttcgacaataacgtccggtatgttgattaatggtggcaaagaagtcattaccacatcggttgatcaagtaatacgcgcttgggaaattaccgcaggcaagctttcactggtagataaaaagcgtaccactgtggcggatacaggatcattagaaatcatttccaatgatgaagatgctgattctgagaaaacgttactgatcggaggtgttggtttatcaatttggaaaaaatga

SEQ ID NO: 152 - DNA, 933 bp, Saccharomyces cerevisiae
atgcaatacaaaaagactttggttgcctctgctttggccgctactacattggccgcctatgctccatctgagccttggtccactttgactccaacagccacttacagcggtggtgttaccgactacgcttccaccttcggtattgccgttcaaccaatctccactacatccagcgcatcatctgcagccaccacagcctcatctaaggccaagagagctgcttcccaaattggtgatggtcaagtccaagctgctaccactactgcttctgtctctaccaagagtaccgctgccgccgtttctcagatcggtgatggtcaaatccaagctactactaagactaccgctgctgctgtctctcgtgatggtcaaattcaagctaccaccaagactacctctgctaagactaccgccgctgccgtttctcaaatcagtgatggtcaaatccaagctaccaccactactttagccccaaagagcaccgctgctgccgtttctcaaatcggtgatggtcaagttcaagctactactaagactaccgctgctgctgtctctcaaattggtgatggtcaagttcaagctaccaccaagactactgctgccgccgtttctcaaatcggtgatggtcaagttcaagctactaccaagactaccgctgctgctgtctctcaaatcggtgatggtcaagttcaagcaactaccaaaaccactgccgcagctgtttcccaaattactgacggtcaagttcaagccactacaaaaaccactcaagcagccagccaagtaagcgatggccaagtccaagctactactgcttggctattggtgacaatgatgtcttctaccaatgtttgtccggtactttctacaacttgtacgacgaacacattggtagtcaatgtactccagtccacttggaagctatcgatttga

SEQ ID NO: 153 - DNA, 345 bp, Saccharomyces cerevisiae
atggttgatttgatgactgtcatcatggtgagatattcgttgtttcttacttgggaactggtgctgttgcaactgttgctgctccggttgtcttttcatgtgagcagaactaaaatcttggtcttggtcagaatctcgattatccttcaccatgacgagaatgcgtatacgcagagccaatataatctgtatacgggacctttgacattaaggtttctgcagagagtttattacatgcattttcatatatatatttttaacgccattcctttacggtatgtaaagaaaaatgatccaatgagcggcccttcgtacgagatgagatataataagaatgaaagatag

SEQ ID NO: 154 - DNA, 375 bp, Saccharomyces cerevisiae
atgttagtacgagacatagccgccgaggtttatttcgctcaatctgtttgtttcagtttttccgcgttctctctttttcgctcttttctggctaccgcgcccgccttatatataaaatctcttccgaataacaaagtggccgaaacaagcgccaacgtcgaccattttgccaccgtgtcactgtgcacgagcaacgaaaaactggcgttggttgcgcctcacgaattgcttgagcctcttcccaatatcatcgcgcatttatttgagtcattctctgccgctttattattaaaagtctgtgtgctatcaaaatgctcttgctcctgttcaccctctatgcgtaaacacttgcgcgtttctccctttctcttttag

SEQ ID NO: 155 - DNA, 1644 bp, Saccharomyces cerevisiae
atgactaaatcggttggtgatgaagagtcacagtacattgaggaccctagttttgcagcagcagctgcatttactggcggcagggacggggtttcgtacagtaatcagcgatttgctgagggttccggccattcttctgacttagcaaagtcattagaagactatcggcctcctgatgaaaagccgtcctcattgtcatctgtgggggaaggtggcgctaatgaggaagagaagggcggtaacgacggcggtcccttggcaagaattcaaacagggcttttttctccaagactgcgaaatcataggaaaaagattctctcgaagtttgttttgaacaacttcttcattgcttgtgtgtgtgtatcgctcatatcgatttactggggtgcctgttacggaacagatcgttactttttcaaagtgaaaaatattgttgtattgcaggatgcgccatctaatacttcagttcaatctatttccgcgatcataccctcattgttagcgtctgtccccgggacatggcatatatacaacgcaacatcatttcataggaaatttggtacgacgaactccaccgaaattgacagaaagatagtcgatttaatttacgatgagagatactggctggcgttaaacgttaaacctaatgctacagacactttgtataattctttgattagccaagacgcaaactcggagttcaattcatcaattttttttgaatccgtgtttgaaagtggtcgtgacccatcgagtgttaaatcgaccattctaccactcatgcaacaattggaggtccgccttcagaaatattacgtcaaggaatatcttccctcattgatgagcaacatcacttctaatgacagagatcttaatataaacatggagaactgggcgattgcaggacagttgttgttcacctacaacgattatcgtccctttgctgatcgtattctaatggcccctctgcaggtcggtctgatttattgtattttgttaaccgttttacaactgtcattatatggtaagttgcacggagaaatggccagagttctgaagccaaagcatattttaatctacaggcttctaatttcctgggcaacttattttcttctttccattggattctgtaccgtatctgcaatttttaggatcgatttcacccccgcctttggcagaggaggattcgtagtatattggatgtctacgtggttggtaatgatggctgttggtggtgccaatgaaaacgttctcagcttagttatagcttactgccctccatacctgagtatttggttgatgacgtggatcatattaaatatttctgcttcattctacccaatggttttgaacaacgaattttacaggtacggctacataatgccaatccataatgccgtggatatctataaagtgatttttttgaatttaaccaaaagaaaaatgggaagaaattacggtattctcgtggcatgggttgccctcaatacatccttgatgccattttgtatgaagtttgcaggtaaaaaaatgcaaaaaaatgctatgcaagcagcagaagccgctgtcgcagcagctacccagcgtgctagccgcccggcagaggccaatactgataaaaataacaacccgcccggaaattaa

SEQ ID NO: 156 - DNA, 1761 bp, Saccharomyces cerevisiae
atgtcggatcattctcccatttctaataaggaaaatcatctgctgccatcagactcgtcaagaagctcatccagcgatatgcattcgacgggcaccacgggaaccacaggcgtcgaacctgtagatttcaccggtgaaggtgccaaatacacaactgctacggagggcaatggtggtgcagatttagcgattcaaagaacgacgactatgaattctgctgcagaatcagaggttaatatcacgagaagattaactaaaatccttactgggtctgttaacgagcctgaccgtgtagaggttgattataccaattgtgcgcccatgggtggtgacagaccttaccctccatcgttgccgagcagagacctgtacgaggttacttttgatggtcctaacgacccactacatccatttaactggcccatgaagaagaaagtgctgctatgtctggtcttatgtctggattctattgccattgctatgtgttcttccatttttgcctctgcagtgccgcaaatctgcgagatataccacgtcatcgaagttgtcgccattttgggtatcacgctttttgttcttgggtttgcggcctcaccggttatctatgctcctctttctgaattgtacggtagaaagggtgttctggttttatctgcgtttggatttgcccttttccaatttgctgtcgctactgctgagaacctgcaaactattttcatatgtagattctttggtggttttatcggggcagcacccatggccgtcgtccccgccgcgtttgccgacatgtttgatactaatgttagaggtaaagccattgcgctattttctctaggtgtttttgtaggccccattttatcgcctgtcatgggttcttatatcgcacaaagaactacctggagatggttagaatatgttgtcggttgtttcgcttccgcagttttcgttgccatcgtattgttctttgaagaaacacatcaccctaccattttggttaacaaggccaaacagatgagaaagcaaagtaataactggggtattcatgctgctcatgaagacgtggagctatccatcaaagacattgtccaaaaaactgtgacgaggcctatcattatgcttttcgtggaaccattgctactattcgtgactatttacaactcttttgtctacggtatcttgtatttgttactggaagcctacccacttgtctttgtggagggttatgggtttactgaaaacggtgagttgccatacatcgccttgattatcggtatgatggtgtgtgctgctttcatttggtatatggacaacgattatttgaaaagatgtagagccaaggggaaattagtgcccgaggccagattgtacgcaatggtcattgcaggtaccgttttccctattggtatcttatggttctgttggacgggctactatcctcacaagattcattggatggtccccacagtaggaggggccttcatcgggttcggtttaatgggtattttcttgccatgtttaaactatatcattgaatcgtatctattgttggcagcttctgccgtcgcagcaaacactttcatgaggtctgcatttggtgcatgcttcccattgtttgcaggatatatgttccgtggcatgggtatcggttgggctggtttgttattaggtctatttgccgctgcgatgattcccgtgcctttactattcttaaaatatggtgaatctatcagaaagaaatccaagtatgcttacgccgcttaa

SEQ ID NO: 157 - DNA, 810 bp, Saccharomyces cerevisiae
atggtgcttagtgattcgttgaagctgccctcgcctacactttcagctgctgctggagtggatgattgtgacggagaggaccaccccacgtgccagaattgtttcactgtcaaaacgcccctatggagaagagatgaacacggtactgttctctgtaatgcatgtggcctcttcctgaagttgcacggggaaccaaggcctatcagcttgaagacggacaccattaagtcaagaaataggaaaaagctgaataacaacaatgtgaacactaatgccaatacccattctaacgacccaaataaaatattcaagagaaagaagagactgcttacaactggtggtggttcattacctacgaataatccgaaggtttctattctggaaaagtttatggtgagcgggtccattaagccactgttaaaaccaaaggaaaccgttcccaacacaaaggagtgctccacgcagcggggaaaattttctttggacccctgcgaacctagtgggaaaaactacctctatcagatcaacggttcagatatatacacgtcaaatatagagctgacaaggctgcctaatttgtcaacattattagaaccctcacctttttcagattccgctgtaccagaaatagaactaacttggaagctacataatgaggaggaggtaatcaaattgaagaccaagataagcgaattggagttggtgacagacctatacaaaaagcacatattccaactgaacgaaaaatgcaagcaactggaagtggaactacactccagagcttcagtacaatctcacccacaacattaa

SEQ ID NO: 158 - DNA, 2970 bp, Saccharomyces cerevisiae
atgttgcggtttcagcgatttgcgtcctcgtatgcccaagcacaggccgttagaaaatatccagttggaggtatattccatggttatgaagtgagaagaattctaccggttccggagctgagactcactgcggtagatttggtgcactcccagacaggagccgagcatttgcatattgatagagacgacaagaataatgtgttcagcattgcttttaaaaccaaccctccagattccactggggtccctcatattctagagcatacaacgttgtgtgggtctgttaaatatccagttagggacccttttttcaaaatgctaaataaatctctagctaatttcatgaacgctatgacaggtccagattatacattttttcccttttccactacgaaccctcaagatttcgctaatttaagaggtgtttatttagactccaccttgaatccgctacttaaacaagaagattttgatcaggagggttggaggttggagcataaaaacatcacagacccggagagtaacattgttttcaaaggtgttgtctataacgaaatgaaaggtcaaatatcaaatgccaattactatttctggagtaaatttcaacagtctatttatccttccctgaataactccggcggagatcctatgaaaattacagacttgagatacggcgatctcttggatttccatcacaaaaattaccatccctccaatgcaaaaactttcacgtacggtaacttgccattggtggatacgttaaagcaattaaatgagcagttcagtggttacgggaagagagctcgaaaggataagttgttaatgcctattgatttaaaaaaagacatagatgtcaagttactgggtcaaatagatactatgcttccaccggagaagcagacaaaagcctcaatgacgtggatttgtggagcgccacaggacacatatgatacctttttgttaaaagtactggggaatttattaatggatggccattcttctgtaatgtatcaaaaattaatagaatcaggaattggtttggagttctccgtaaattcaggtgttgaaccaactacagcagtaaatttgctaactgttggtatacagggcgtgagtgatattgaaatatttaaagacactgtaaataatatttttcaaaacctgttggaaacagaacatccttttgaccgcaagcgtatcgatgccataattgaacaattggaattatctaagaaggatcaaaaggctgactttggacttcaattactctattctatactacctggttggacaaacaaaatcgatccttttgagagcttgttgtttgaggacgttttgcaaagatttagaggtgacttagaaacgaaaggtgatactttattccaagatttaatccgtaaatatatcgttcataaaccttgtttcacgttttccattcagggatctgaagagttctctaaatctttggatgatgaagaacaaacaagactgagagaaaaaattactgccttggatgaacaagacaagaaaaacatctttaaacgtggtatactgttacaggagaaacaaaatgaaaaagaagatttatcctgtttacctaccttacaaataaaagacatcccaagagctggtgataaatattcaatcgaacagaagaataatacaatgtctaggattactgataccaatggtatcacatatgtcagaggtaaacgtttactaaatgacataataccctttgaactcttcccatacttacctttatttgctgaatcgttaactaacctagggacaacaacagaatccttcagtgaaatagaagatcagataaaattacatacgggtggtatatcaacacatgtagaggttacatctgaccctaacaccacagagcctcgcctgattttcgggtttgacggatggtctttaaattcgaagaccgaccacatttttgaattctggtctaagatcttactagaaactgatttccataaaaacagcgataaattgaaagttcttatccgcttattagcatcttcaaacacatcttctgtagcagatgccggtcatgcatttgcaaggggctattctgccgcacattatagatcaagtggagctataaatgagaccctcaatggtattgagcaactacaatttataaatagattgcacagcttgttagacaatgaagaaactttccaaagagaagttgtcgacaagctaactgaattgcaaaagtacattgttgataccaataacatgaatttttttatcacctcagactctgatgttcaagcgaaaacagtagaaagccaaatttcaaaattcatggagagattacctcatggcagctgcttgcccaatggaccaaagacttcagattatcctcttattggatccaaatgtaaacatactttgataaaatttcctttccaggtccattacacatcccaagctttattgggtgtgccgtatacacataaggatggctctgcacttcaagttatgtcaaatatgctaacattcaaacatttgcacagagaagtcagagaaaagggtggtgcttatggtggtggtgcttcttatagcgccttagcgggtattttcagtttctattcctatagggatcctcagcctttgaagagtttagaaaccttcaagaatagcgggcgttatatactgaacgatgccaagtggggcgtcacagaccttgatgaagctaaattgacaatatttcaacaagtagacgcacctaaaagtcccaaaggagaaggcgtgacgtatttcatgagcggtgttacagacgatatgaaacaagcaagaagggaacaactcttagacgtatctctcctggacgttcatagagtcgccgaaaaatatctactaaacaaagaaggggtgagtacggtcattggacctggaatcgaggggaagactgtttcaccaaattgggaggtgaaggaactgtag

SEQ ID NO: 159 - DNA, 1764 bp, Saccharomyces cerevisiae
atggatatactcaagaggggaaatgaatcggacaagtttacgaaaatagagacagaatctactacgataccaaatgactcggatagatctggttcactgatcagaagaatgaaggattccttcaagcaaagtaacctgcatgtcattccagaagaccttgaaaacagcgaacagacagagcaggaaaaaatccaatggaaactagcttctcagccctatcaaaaagtcttgagccaaaggcacttgaccatgattgccataggtggtactttggggacgggactgttcattggtttaggttattctttggcatctgggccagccgctttgctaatcggttttttgttagttggtacttcaatgttctgtgtcgttcagagtgccgcagagctttcctgccaattcccggtttctggctcatatgccacacatgtcagtaggttcatagatgaatcggttggctttactgtggctacaaactatgctttggcttggctgatttcttttccaagcgaattaattggttgtgcacttactatttcatactggaaccaaacggttaatccggctgtttgggtggccattttttatgttttcattatggtactgaacttgtttggtgtgagaggctttgccgagactgagtttgctctgtcaatcattaaggttattgctatatttattttcatcattattggtatcgtccttattgccggaggggggcctaactctactggttatattggcgccaaatactggcacgacccaggtgccttcgcaaaacctgtcttcaagaatttgtgtaacacattcgtttctgctgctttttcctttggtggtagtgagttagtgctgttaactagtacagaatctaaaaatatttcagctatatcacgtgctgccaaaggtacgttctggagaatcgcgattttttacattactaccgttgtcattattggatgtctcgtaccttataacgaccccagactgctcagtggttcgaacagtgaggatgtatctgcctctccctttgttattgctttgagtaatacaggatcaatgggtgcaaaagtttccaactttatgaatgtcgttatccttgttgcggttgtgtcagtttgcaattcttgcgtttatgcttcttcaagactaattcaagctttaggtgcatctggccaacttccttcggtatgttcctacatggacagaaagggtaggcctttggttggcattgggattagtggtgcatttggtcttttaggttttcttgtggcctcgaaaaaggaggacgaggtcttcacttggcttttcgccctttgttccatttcatcattcttcacctggttctgtatttgtatgtcacaaattagatttaggatggctttgaaagctcaaggaagatccaatgacgaaatagcttacaaatccatactgggtgtttatggtggaattttggggtgtgtgctaaatgcattgctaattgcgggtgaaatatacgtatcggccgccccggtcggtagccctagctccgctgaagccttctttgaatactgtttaagtattccaatcatgattgttgtttattttgcacataggttttatcgaagagattggaaacacttctacatcaagaggagtgagatcgatctggatactgggtgttccgtggagaatctagagcttttcaaagcacaaaaagaagctgaggaacaactcattgcttctaagccattctattacaaaatctacagattttggtgttag

SEQ ID NO: 160 - DNA, 3165 bp, Saccharomyces cerevisiae
atgactattatcgtcgcttctttattcttaccatatacccctcaattcgaggctgatgtcaccaactcggatactgctaagctggttgaatcaagtatgatcaaggtagactgcaacaaccaggaattgagcaacaacaagcaagaaagaagcagttctgtaacttcggcaagctctcattatattggcttacctcaggaggcgcaaattaacggtgaacccttacaaagggccaatgtgggctctcctgctacgggagttaactatcataatgagatggaaatgctttcctcagagcaattcctggaagagctgactgccaatgccactcatgcagcaaactctggtattccgccagctaataacccagtttcttctggctcaactgcccagcggccttcagtcgaggaattcttttctgctccgtctgctagagtctgttctccctcccaggaagcttctgcttcgtctatttctgctagtcgttcatcggctcaccacaacgatttgagctccagccttatgaaaaatcccaatttgtcatttgattcacatccacccagggtcagaagctcatccaagagtgctgtaatcactcccgtctctaaaagcgttccagatgtcgatcctgctgttgtagatgtcgcaaaagttagagaagagtttcaacagcaagcctccttgccttccatgaaaagagtttccggaagcaccgctggagactcttccattgcttcttcgagttctaatctcaggtactcacagcaatttcaggataactttatcgaagacactgatagtgaggatgacattgattctgatttggagaccgatgctactaagaaatacaacgtcccaaaatttggtggctattccaataacgcaaagttaagagcatctctaatgagaaactcgtatgagctattcaaacatttgccatggacaatagtcgacagtgacaaagggaacggatccttgaaaaatgcagttaatattgcagttgctgaaaagacagtgaaagaacctgtttcctgggtaggtacaatgggaatccctactgacgaacttcctcacgaagtttgccataagatttcaaagaaattagaacaggatttttcttcttttccagtggtcacggacgatattacttttaagggtgcttataagaactacgccaaacagattttatggcccactctacattatcaaattccagataatccaaattcaaaggcttttgaagaccattcttgggactactatcaaaaagtgaatcaaaagttttctgataggatagtttccgtttacaaacctggcgacacaatttggatccatgattatcatttgatgcttgtcccacaaatggtgagagagaaactgcctaaagctaagattggatttttcttacacgtatcatttccaagtagtgaggtcttcagatgccttgctaacagagaaaggattcttgaaggtattattggtgcaaactttgttgggtttcaaactaaagaatacaaaagacatttcctacaaacttgtaacagattgcttgctgcggatgtctctaatgatgaagtcaaataccattgcaatattgtttccgtgatgtatgcgccaattggtattgattattaccatttgacatcgcagttgagaaatggttctgtacttgaatggcgccaattaattaaagaaagatggcgtaataaaaaactgattgtttgtcgcgatcaatttgacagaattagaggtcttcagaaaaaaatgttagcctacgagaggtttttgatagaaaaccctgaatacatcgaaaaagttgttttgatccaaatctgcatcggtaagagttccgatcctgagtacgaacgtcaaattatggttgtcgttgatagaatcaattctttgtcttcgaacatcagtatctctcaaccagtggtctttttgcatcaagatttagattttgctcaatatttggcattgaattgtgaagctgacgttttccttgtggatgcgctgagagaaggtatgaatttaacatgtcatgagttcattgtcagttcattcgaaaaaaatgcgcctctattattatctgaattcactggtagttcttctgtcctaaaggaaggtgccatcttaataaacccatgggatataaatcatgtagcacaaagtatcaagagaagtttagaaatgtctccagaagaaaaaaggcgtaggtggaaaaaattattcaaatctgttattgaacatgattcggataattggattacaaagtgcttcgaatacataaataatgcttgggagtccaaccaagaaacgtctactgttttcaatttggctccagaaaaattctgtgctgattacaaagcctccaaaaagcatttatttatcttcaagatttcagaacctccaacgtccagaatgctatccttgctaagtgaattgagttcaaataatatagtttacgttttgagttcatttacaaagaatacattcgaaagcttatacaatggtgttctaaacatcggattgatagcggagaatggtgcctacgtaagagttaatgggtcgtggtacaacatcgtggaagagcttgattggatgaaagaggtggcaaagatctttgacgagaaagtcgagaggttacctggttcatactacaaaatcgctgattctatgatcagattccatacagaaaacgctgatgatcaagatcgagtcccaactgttattggggaagccattacgcacataaacaccttatttgatgacagggatattcacgcttatgtgcataaggatattgtcttcgttcaacaaacggggctagccttagccgccgctgagtttttgatgaaattttacaacagtggcgtcagtcctactgacaatagcagaatatctctatcaagaacatcctcttcgatgtccgtcggtaataataagaagcatttccaaaaccaggtagatttcgtttgcgtttccggttcgacatcacctattattgaaccattatttaaattagtgaagcaagaggttgaaaagaacaatctaaaatttggttacaccattctttacggtagctcaagatccacttatgccaaggaacatatcaatggtgtcaatgaactttttaccatccttcatgacttgacagccgcctaa

SEQ ID NO: 161 - DNA, 309 bp, Saccharomyces cerevisiae
atgtcttttagaaagaaaaaactcaaacctccagcgggtagtcaatttattataaacgactccataatgagctatattgaccgcacgaaaacactaataaggatgattggatgcaagaaccagtacataaaagcacgtatgaaagataagaccttcttctatacgaagcaattccgtacagccaaaaacaaatttttctttcatctgtaccattgggaggccactcatattaacgttgaccactatatatgtacatgtcatcccattttttggggctctataggtcagaaactcaggagatccgcctga

SEQ ID NO: 162 - DNA, 2835 bp, Saccharomyces cerevisiae
atgatatcagcactagattctatacccgagccccaaaactttgcgcctagtccagatttcaaatggctttgtgaagagctatttgtgaagatacatgaagttcaaattaatggaacggccggcactggcaaatcaaggtctttcaagtactatgaaataatatcgaatttcgtcgaaatgtggagaaaaaccgtgggaaataatatatatcctgcactggttcttgctcttccctaccgcgatagacgaatctataatattaaggattatgtattaataagaactatatgctcttacttgaagttgccaaaaaattctgcaacagagcagcggttaaaagattggaaacagcgtgtcggtaaaggtgggaatctttcttctcttcttgtggaagaaattgctaaaagaagggctgaacctagctcaaaagcgattacaattgataacgtcaatcactatctggatagtttgagtggagacaggttcgcttccggacgaggatttaagagtcttgtcaagtccaaacctttcctgcactgtgtggagaatatgagtttcgtcgaattaaaatacttctttgatatcgtgcttaaaaatagagtaataggaggtcaagagcacaaattgctaaactgctggcatcctgatgctcaggattatcttagcgtgatatctgatttaaaggtggtaacttcaaaactttatgatccaaaagttcgtctaaaggatgatgatttgagtataaaagttggctttgcattcgccccccaattagccaaaaaagtgaatctttcttatgagaaaatatgccgtacactacatgatgattttttggtagaagaaaaaatggatggagaacgaattcaagttcattatatgaattatggtgaatccataaaattttttagtagacggggcatcgactatacctatttgtacggagcgagcttatcatcaggaactatatctcaacatttgaggtttacagatagtgttaaagaatgtgttttagatggagaaatggtgacgtttgatgcaaaaagacgggtgattcttccattcggtcttgttaaaggaagtgcaaaggaagcgctatcttttaatagtataaataatgttgactttcaccccttatatatggtgtttgatctgttatacctgaatgggacttcgttgacaccattaccccttcatcaaaggaagcaatatctgaacagcattttaagtcccttgaaaaatattgtagaaatagtacgatcttctagatgttatggtgtggagtcaatcaaaaagtctttagaagttgcaatctcactgggttcagaaggagttgttttgaaatattataattcaagttataatgtcgccagtcgaaacaacaactggatcaaggtaaaacctgaatatttggaggaatttggagagaatttagacttaatagtaataggcagagattctgggaaaaaagattcttttatgctagggttacttgtgctagatgaagaagagtataaaaagcaccaaggagactcctctgaaattgtagaccactcaagccaagaaaaacacatacaaaattcaagaagaagggtgaaaaaaatactttcattctgttctatcgcaaacggtatatctcaagaagaattcaaagaaatcgaccgcaaaacgagaggacattggaaaagaacctccgaagttgctccccctgcttcaattttagaatttggctcaaaaatacctgccgaatggattgaccccagtgaatcaattgttctagaaataaaatcacggtctttggataacacagaaacgaatatgcagaagtacgctaccaattgtactttgtacggtggctattgtaaaagaatacggtacgataaagaatggacagattgttacacacttaacgacttatacgaaagtaggacggttaaatctaaccccagctatcaagcggaaaggtcacagcttggattgatacggaaaaagagaaagagagtacttatttcagacagctttcaccaaaacaggaaacaactgccaatttcaaacatctttgccggattacttttttatgttctctctgactatgtcacggaggacactggaatacggattacacgggcagaacttgaaaaaactattgtggaacatggtggtaaactgatatataatgtaattttaaaacgtcattcaattggggacgttcggttaatcagctgtaaaactaccacggaatgcaaggctttaatagatcgaggatatgatatattgcacccaaattgggtactcgattgtatagcatataagaggctcatcctgatcgagcccaattattgctttaacgtctctcaaaaaatgagagccgtcgctgaaaaaagggtagattgtttgggtgatagttttgaaaatgacatttcggaaaccaaactgtcatcattgtataaatcacaactaagtctaccaccgatgggggaactcgagatagattctgaggttcggcggtttccattatttttattctccaacaggattgcatacgtaccacgtcgcaaaattagcacagaagatgacattatagaaatgaaaattaagttgtttggtggaaaaataacagatcaacagtcactttgtaacttaataattataccatatactgatcctattttgaggaaagactgcatgaatgaggtacacgaaaaaataaaagaacaaataaaggcttctgatactataccgaaaatagccagggtcgttgcccctgaatgggtggatcattctattaatgaaaactgtcaagtgcctgaagaagacttccccgtagtcaactactga

SEQ ID NO: 163 - DNA, 1023 bp, Saccharomyces cerevisiae
atgtctacagacaagatcacatttttgttgaactggcaaccaaccccataccatattccaattttcttggctcaaaccaaaggttacttcaaggagcaaggtctagacatggccatcctagaaccaaccaatccttccgatgtcactgagttaattggatctggtaaggtcgacatgggtttgaaagccatgattcacaccttggctgccaaggcccgtggtttcccagtgacctctgttgcctctttgttggacgaaccatttaccggtgtcttgtacttaaagggcagtggtatcactgaagacttccagtccctaaagggtaagaagatcggttacgttggtgaattcggtaagatccaaatcgatgaattgaccaagcactacggtatgaagccagaagactacaccgcagtcagatgtggtatgaatgtcgccaagtacatcatcgaaggtaagattgatgctggtattggtatcgaatgtatgcaacaagtcgaattggaagagtacttggctaagcaaggcagaccagcttctgatgctaagatgttgagaattgacaagttggcttgcttgggttgctgttgcttctgtaccgttctttacatctgcaacgatgaatttttgaagaagaaccctgaaaaggtcagaaagttcttgaaagccatcaagaaggcaaccgactacgttctagccgaccctgtgaaggcttggaaagaatacatcgacttcaagcctcgattgaacaacgatctatcttacaagcaataccaaagatgttacgcttacttctcttcatctttgtacaatgttcaccgtgactggaagaaggttaccggttacggtaagagattagccatcttgccaccagactatgtctcgaactacactaatgaatacttgtcctggccagaaccagaagaggtttctgatcctttggaagctcaaagattgatggctattcatcaagaaaaatgcagacaggaaggtactttcaagagattggctcttccagcttaa

SEQ ID NO: 164 - DNA, 2781 bp, Saccharomyces cerevisiae
atggagcagaatattattagtaccataagggatgagtgtattcgtcaccggtcgaagtaccttacgatagcacaactaaccgctattgcagaggctaaaattaacgaattcatcataactggtaaggcaaaagatcaagatttgagcagtcttctagataaatgcatcgatattttatctatttacaagaagaactcgaaagatatcaaaaatattatatcgtgcaaaaataagggtgcaatgattagttcaaattccgtaatgattattcaattaaattatgtttactacaaggtaattcacattattgtaacaaccaatattcctcatttaagtgaattcgccaagattaaattacataagagcacgagtgatgagggcaacggtaataacaacaataatgaatttcaactcatgaacatttacaacactttgctggaaaccttattaaaagatgaaaacattgcaaaaataaaaagtttcattaagtcttccataaaacaaacaaaattgaaccatgagcaagaagaatgtaacctgatgagaacgggttcctatatcacttccaatcaattaaactccctaataagttcatcagcaaattctgcttcctcccaaatggagatactactgatagatatacgatcaaggttggaattcaacaagtcacatattgatacaaaaaatattatatgcctggagcctatttcttttaaaatgtcatattcagatcatgatttggagaaaaaatcattaattacttctcctaatagtgagattaaaatgtttcaaagtagaaatcttttcaagtttatcattctctatacagacgcaaacgaatacaatgttaaacagcagtctgtcctgttggacattctggtgaatcattcctttgaaaaaccaatatccgatgactttaccaaaattttcattctggaatctggttttccaggttggcttaagtcaaattatgggaggcaagtatcatcatcttttccatcaaataacaatattaaagatgatagtgtttatattaatggtaacacttctggcctaagtttacaacatttacctaagatgtctcccagtataagacattcaatggacgactctatgaaagaaatgctagttgcgcctactccattaaatcatcttcaacaacagcaacaacagcaatcagacaatgatcatgtgctaaaaagatcttcaagtttcaaaaaattattctcaaattatacgtctcctaatccgaagaattcaaattcaaacttatattctatatcttcgttgtccatatctagttcaccatcgcctttacctctacattcgcctgacccagttaagggcaattcattgccaatcaattatccggaaacgccacatctttggaaaaacagtgagacagattttatgacaaatcaaagagaacagttgaatcacaactcttttgctcacatagctcctatcaacacgaaggccatcacttctccatcaagaactgccacaccgaagttacaacgcttcccgcaaacaattagtatgaaccttaatatgaactccaatggacacagttctgccacctctaccattcaaccttcgtgtctatccttgtctaataatgactctttagatcatacagatgttacaccaacttcttctcataattatgaccttgatttcgcggttggtttggaaaatctaggaaattcgtgttacatgaactgtatcattcagtgtatcttaggtacacacgaattaacccaaatctttttggacgattcatatgctaaacacatcaatattaatagtaagttgggatcgaaaggtattctggcaaaatattttgcaaggttggttcatatgatgtataaggaacaggttgatggttcaaagaaaatttccatatcaccgataaaatttaaattggcatgtggatctgttaactcattatttaagactgcatcccaacaggactgccaagagttttgccaattccttctagatggtcttcatgaagacttgaaccaatgcggttcaaacccacctttgaaggagctttctcaagaagctgaggcgagaagagaaaaactgtctttgcgaattgcctcgtcaattgagtgggaacgattcttgactactgatttcagtgttattgtcgacttatttcagggacaatacgcctcacgactaaaatgtaaagtctgtagtcatacctcgacaacataccaaccttttacggtgctgtcaatccctattcctaaaaaaaattcccgaaataatattaccattgaagattgtttcagagagttcaccaaatgtgagaacttggaagtggatgagcaatggttgtgcccacattgtgaaaaaaggcagccctccacgaaacaattgacaataacgagattaccgaggaatctgatagtccatttaaagagatttgataatttattaaacaaaaataatgacttcgtcatatacccttttttgttggacttgactccattttgggccaatgattttgacggggtttttcctccaggtgttaatgacgatgaactaccaataaggggacaaataccaccttttaagtatgaattatatggtgtagcatgccactttggtactttgtatggtggtcattatacagcctatgtgaaaaagggattaaagaagggatggctatattttgatgataccaaatataaacctgtcaaaaacaaagccgatgcaattaactctaatgcatacgttttgttttatcaccgcgtctacggtgtttga

SEQ ID NO: 165 - DNA, 1464 bp, Saccharomyces cerevisiae
atggcttactctaaaatcacattactagccgctcttgctgctattgcttacgctcaaacccaagcacaaatcaacgaattgaacgttgttttagatgatgttaagaccaacattgccgactacatcaccctatcctacactccaaattcaggtttttccttggaccaaatgccagctggtattatggatattgctgcgcaattggttgcaaatccaagtgatgactcctacaccactttgtactctgaagtggacttttctgctgttgagcatatgttgactatggtcccatggtactcttctagactgcttccagaattagaagcaatggatgcttctctaactacctcaagttctgctgccacatcttcaagtgaagttgctagctcttctattgcttcatccactagctcttctgttgcaccatcctcaagtgaagttgtcagctcttccgttgcaccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcatcctcaagtgaagttgccagctcctctgttgcgccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcttctacaagcgaagctactagttcttctgctgtcacatcttcctccgctgtttcctcttcgaccgagtctgttagctcttcctctgtcagttcttcctcagccgtttcctcttctgaagctgtcagttcctctccagtttcctcagttgtttcatcttcggccggacctgctagctcaagcgttgctccttacaactcaaccattgctagctcttcttccactgcccagacttctatctcgaccattgctccttacaactccacaaccaccaccaccccagctagttctgcttccagcgttattatctcaaccagaaacggtaccactgttactgaaactgacaacactcttgtcaccaaagaaaccactgtctgtgactactcttcaacatctgccgttccagcttccaccaccggttacaacaattctactaaggtttcaaccgctactatctgcagtacatgcaaagaaggtacctctactgcaactgacttctctacactaaagactacagttaccgtatgtgactccgcctgtcaagctaagaagtctgctaccgttgttagcgttcaatctaaaactaccggtatcgttgaacaaaccgaaaacggtgctgccaaggctgttatcggtatgggtgccggtgctttagctgctgttgccgccatgctactatga

SEQ ID NO: 166 - DNA, 534 bp, Saccharomyces cerevisiae
atgtttcgagccggatcatcaaaaagattcttacgaaacacactaatagcaatttcatgggttccggtacttctaacaatcaataataatgtggtccatattgcgcaagttaaaggtacctctatgcagcctacgctgaacccgcaaacggaaacgctggcaacagattgggtgctgctttggaagtttggagtcaagaacccaagtaatttatctagagatgacattatccttttcaaagctcctacaaaccctcggaaagtttactgcaaaagggttaaaggtttaccgtttgataccattgacacgaagtttccataccctaaacctcaagtgaacctgcccaggggacacatatgggtcgaaggggacaattattttcattcgattgatagcaatacttttggccccatttccagtgggttggtcatagggaaagctataacaattgtttggccaccctccaggtggggaacggatctcaaactgagtaccggtagagactgcattagcaaaagagccattttagaatga

SEQ ID NO: 167 - DNA, 1395 bp, Saccharomyces cerevisiae
atgggacaaattctatcaaacccggtaattgataaagagagccactccggtgctgactccttgaccgcgtttggactgtgtgcaatgcaagggtggcggatgtcaatggaggattcacacattctagagcctaatgttttgacaaagtccgataaggaccatattgcattttacggtatattcgatggtcatggtggcgctaaagtagcagaatactgtggtaataaaatagtggagatcctgcaagagcagaaatcgttccatgaaggaaatttaccaagggctttgattgatactttcataaacacagacgtgaaactgttacaagatcctgtgatgaaagaagaccatagcggatgtacggctacatccatattagtatcaaagtcccagaacttgttagtatgtggtaacgctggtgacagtagaaccgtactcgccaccgacgggaacgcaaaggcattatcatacgatcacaagcccactctagcaagcgaaaaatcacgtattgtggcagctgatggcttcgtagaaatggatagggtcaacggtaacttggcgctctctcgtgccattggtgattttgagttcaaatccaaccccaaattgggccccgaggagcaaatagtgacatgtgttccggacattctcgagcattctctagattacgatagggacgagtttgtaatcttagcctgtgatggtatctgggattgtttgacttcccaagattgtgtggacttggttcatctcggccttcgcgaaggcaagacattgaatgaaatttcttcgcggatcatcgatgtctgttgtgctcccaccacagaggggacgggtattggatgcgacaacatgagtatagtggttgtcgcgctgctgaaagaaggtgaagacgtcgctcaatggagcgaccgtatgaagtccaaggcccaccgcacatcagtgcgttcttttgcagacaagagaagaagggtgtttagttactacgatttttccaaatgtaacgacgaacaggtgttcgctatcactacgaagaaacctcaggacaaattcactcgcgaccacgaagccgctgtggcctcggtgactgccgccgataacgacgatccaatggacatagacgacacggacgctgacacagatgcagaaaatcttgacccttccagccaatccaagagcaagacctccggccccattgatctagcatccttggaggcgctacttggtgctacaggaggagtgaagacagacagcaacgggaacaaagtcacctacactcttccccagtctgccttggcccaactgctccaaaccatgggccatgacccggcttcctcccatcccgagaatgacagtaacactgaccacaaggccggccgttcccacttgcaatga

SEQ ID NO: 168 - DNA, 363 bp, Saccharomyces cerevisiae
atgttctcggatctatgcgatgcgggtcttcttgaatccttgtgcttgatgagaatgtgcaggcatcttacacgcactggatggtctcttaagtgcttgtgtagctggtccttgttggtgccctcaggctcctcccattgcgagtgcttcgtctctggattgaaaaaatactctcttttcttggacttactatacctgacggtccacggggttggcagcccggtcctcgatgctacgtcagatggcattggtgcgtcgttgtggtgccgtagtcggttatgcgtgggaataagtaccacaatgatcattcaggtcctttttctacttagatcgaagggaaaaaggtatgatacccgctcgtga

SEQ ID NO: 169 - DNA, 1845 bp, Saccharomyces cerevisiae
atggccttattggagaagttgcatcgaaggattgttgatatggggcttgtcccgcgtataatcgccttattaccagttatttccatgctatgcgctctatttgggtttatttctatagctattctgcctatggatggacagtacagaagaacatacatttctgagaatgcattgatgccttcacaagcgtatagttactttagagaatctgaatggaacattttgaggggctatcgatctcaaattaaagaaatggtaaacatgacttctatggaaagaaacaatttgatgggttcttggttacaagaatttggtactaagactgctatttacgaaaatgaacaatatggagaaacattgtacggtgtaatgcacgctcctaggggtgatggaacagaagcgatggtgcttgccgttccatggtttaattcagatgatgaattcaatattggcggcgcagctttgggtgtatctttagcaagatttttctcacgttggccagtatggtccaagaatataattgttgtcttcagcgaaaatcctcgtgcagcattaagatcatgggttgaggcataccatacttccttagatttgactggtggttccattgaagctgctgttgtgttggattattcgagtacggaagatttcttcgagtatgtagaaatctcatacgacggtctgaatggtgagctgcccaatttggatcttgtcaacatcgctatatccattacggaacatgaaggtatgaaagtttctttgcacggtctacccagtgatcagttaactaataataatttctggtcaagattaaaaatattatgcctgggaataagggattgggcgttgtccggtgttaaaaagccccatggtaacgaggcatttagcggctggaggattcaatctgtaacattgaaagcacatggaaacagtggtcatgatattactacatttggacgtatacccgaagcaatgtttcgctctattaataaccttttggaaaaatttcaccaatcgttcttcttttatttgttattagcaccacgtcagttcgtatccattagtagttatttgccaagcgctgtggctttatctatagcattcgccataagttcattaaatgcatttataaacaatgcttatgcaaatatatccttattttccgagtataatttggtagcgttgttggtttggttcgtgtcattggtgatatcatttgttgtttcacaagcgtttcttctaataccttcatcgggattattgatgacaattagcatggcatcttgttttttacctttgatactttccagaaaaattcacatctcagaaccactatcatacaggttgaaaaatgttgcttttttatatttcagtttggtttcaacatctttgctaatgataaactttgcaatggctttactgatcggcacattggcatttcctatgacatttgtgaagaccattgttgaaagttctagcgaacatgaggtgacaactcaatcctctaacccaataaaaactgagccgaaagatgagatagagctcgtcgagaatcacatggatacaacgccagcaaccccccaacaacagaaacaaaaactaaaaaatttagtactattaattttgacaaatccatttatttcaataaccttattcggactattttttgatgatgaatttcatggatttgatataataaacaaactggtttcagcatggttggatttgaaatgttggagttggtttgtactttgtataggttggcttccatgttggctattgatattagcgtcatcgtttgaatctaaatctgtcgtagtaaggtcgaaagaaaagcaaagttag

SEQ ID NO: 170 - DNA, 510 bp, Saccharomyces cerevisiae
atgatagcgtggtccctagtggctacgttgcaatgcaaaatgacagggaagagttctttctatacatgtagagcacttatgggcctatttgaaggtggttttgtggctgatttggttctctggatgtcgtacttctacagctcttcagaattgtcaataagactgtcgttcttctgggtgacactatctctaacacaaatcatcacttcaattgtggccttcggggtttttcacatgagagggataggtggcatggcagggtggcaatggctttttttgatagaaagaattttcactttagtcatcggtatcagtgcatacttcttgatggtaccctccgtagttcaaacgaagaaaccttggagcaagaaaggatggttcactgagagggaagaaaaaatcatcgtaaacaagattctgagagatgatccgacaaaaggggatatgaacaataggcaaggtatgtcacttaaaatgttatggcaggggataacagattactatatatag

SEQ ID NO: 171 - DNA, 609 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaagttgtcatttccgtcatggtcgggaaaaatgtaaaaaagttcctgacgtttgttgaagacgaaccagatttccagggcggaccaatcccttcaaagtatcttgttcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgctaggccgaacgacagctctacgatgcgtactttcactgactttgtttccggcgcacctattgtaaggagtcttcagaaaagcaccataaggaaatatgggtacaatttggcagcctacacgtag

SEQ ID NO: 172 - DNA, 1947 bp, Saccharomyces cerevisiae
atgatgttggagccttcacctccacctttaacaacaacggtaacaccctcccttccgtccagtttaaagaaatctgtgacagataatgaccagaataataacaacgtgcccaggaagagaaaactagcatgccagaattgccgtagaagaagaaggaaatgtaacatggaaaagccttgttcaaactgtatcaagtttcgtaccgaatgtgtattcactcaacaagacttaaggaacaaaagatattctacgacttacgtagaagctttacagagccagattcggtctttgaaagaacagttgcaaatattaagttcctcgtcttccacaattgctagcaatgctctctcctcgttaaaaaacaacagtgatcatggtgatgctcctaatgaaaaaatcttaaagtatggcgaaacagcacaatcagcactaccatcatctgaaagcaacgatgagaatgagtctgatgcgttcaccaagaaaatgccttccgagagccctccaccagttggcacaaatagtatatatccatcaaattccttgtctataataaaaaagaagacggatggaagcacaagatatcagcaacagcaggtcagcctaaaaaatttatcaagaagtccccttatcttaagatcgttgtcactctttttcaaatggctatacccgggacattaccttttcattcatagagaaactttcttaagtgctttcttcggtgatactaacactaaaagttactattgttccgaagaattggtatttgcaatcgctgcattgggatctttgatttcatacaaatcagaaactgagctttttcaacaatctgaagtgttttatcaaagagccaagacgatagtactcaaaaaaatttttcaactggaagattcttcgttagctgaatcgtcgtcctcttcgaaattagcaatcatccagactctattgtgtttggcattttatgacattggaagcggagaaaaccccatggcttggtatctttctgggctggcatttaggattgcccacgaaatcggcctacatttgaatccagaagcatggagtaatgtttatgaagacgagctgtcaataatggattttgaagtgagaagtagaatttattggggctgctacattgctgatcatttaatagcgatcctctttggaagatcaacttccttgcgtttgtccaattccactgttccagaaacagacgagctacctgaaattgagactggtatagaggagtacatatatgacccaaaagtaatattgtccactgcaaaccccttgaagaaactgattgtgttatcgagaataacggagatttttgcatccaagattttcagcccaaacgaaactctacttcaaaggagtgaatacttggccaaatttaatctggaggtatacaattggagaagggatttgccccctgaactacaatggaccaagaggtcattgatggaaatgacagattttaacccaaccatagcttacgtatggtttcattactatatcgtgctaatttcctataataaacctttcatatacgaaatcaaacaaagccgggaattggttgaaggttatgttgatgaactgtattatcttttaaaagtttggaaaaataaatttaagacgtttgagaaggccacaatttacatgatttattctgcgattttagccatccaatgcatgaagtccaacttgattaaaaaggatagaaaacaagacttcttaaattttttaagtgcgcctaccctgaattacgaacttgctagaaaattcatagaaaactctgaagatgctttgcataattcagaaactatggatttattagggactctatctcacggtaacgattttgccttagagtacaattttgactttactttattgaatgagattgatatgctgattggtggaaacaccaatgatggtttgtcgaagtaa

SEQ ID NO: 173 - DNA, 1461 bp, Saccharomyces cerevisiae
atgggtactggtaagaaagagaaatctagacgtattcgtgaaggtgacaccaaagatggtaatcttcgtgtgaagggtgaaaatttctacagagactccaagagagtcaaattcctgaatatgtacactagtgggaaggagatcaggaataagaaaggtaatttaattagggccgcttctttccaggactccacaataccggatgcgagggtccaaccagatcgtcgttggttcggtaacacaagagtgatatctcaggacgcactgcagcatttcagaagtgcattgggtgaaacccaaaaagatacatatcaagttcttctgagaagaaataagcttcccatgtcattgttggaagaaaaggacgcagatgaatccccaaaagccagaattttggataccgaaagttatgctgatgcgtttgggcccaaagcccaaagaaagagaccacgtcttgctgcatccaatctagaggacttggtcaaggctacaaatgaagacattaccaagtatgaggaaaagcaagtcttagatgccacattaggactaatggggaaccaggaagacaaagaaaatgggtggacctccgcagcaaaagaagctattttcagtaagggtcaatccaaacgtatttggaacgaattatataaagtcatcgattcgtctgacgtggtaatacatgttctagatgcaagggatccattgggtacccgttgtaagtccgtggaagagtatatgaagaaggaaacaccacacaagcatttaatttatgttcttaataagtgtgatttggtacctacctgggttgcagcagcttgggtcaaacatttgtcaaaggaacgtccaactttggcgtttcacgcatctattaccaactctttcggtaaaggttcgttaattcagttgctacgtcagttctcacagttgcatactgatagaaagcaaatatctgtagggtttatcggctatccaaacactggtaaatcgtccatcattaacacattgagaaagaaaaaggtgtgtcaagttgcaccaatccctggtgaaactaaggtctggcaatatattactcttatgaaaagaatttttttgattgattgtccaggtattgtgccgccttctagtaaagactccgaagaagacattttattcagaggtgttgtcagagtcgaacacgtcacacacccagaacaatatattccaggtgttttaaaacgttgtcaggtaaagcacttggaaagaacttacgagatctcaggatggaaggatgccacggagtttattgaaattctggcaaggaaacaaggtagattactgaagggtggtgagcctgatgagtctggtgtttctaagcaaatattgaatgattttaatagaggtaaaatcccttggttcgtccttccacctgaaaaggaaggggaagaaaaaccaaagaagaaagaagttgagaagacggcatag

SEQ ID NO: 174 - DNA, 1074 bp, Saccharomyces cerevisiae
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggagctataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 175 - DNA, 3306 bp, Saccharomyces cerevisiae
atgacatacccggttagtgcagccgctcctgccgacatttcatattctaaaaataccccgttggtagggctctctaaacctccatgcttgtaccaacacgcttcctcgtccgtcgattcgttttcgtcaacattcagtgatgatgatcgttcggaccttgttgctgtacctaatgagtcgccgcatgcattttcgtataatcccatatcaccaaactcactgggagtaaggttgaccatcttaagaaggtctttggaaataatggtaaacagtcctgacatcttacatgagttgaagaaaaaagcacccgtaatagcataccccccctcacttagacacacaagaaacttaacagagactgccacgttatcagcatcgcgagatccgttaaatgggtctctaatttcaccattagtatccaatatgccatctcctgctagtagacccgtgatacagagagcaacgtccttaatggtgttgcctgataatgatactgccagtaaactgaatccagccaagtccgagttagaaaacttgttattcttgctaaatttagcattggaaaacaattccttcgaaagagcttccgatttacacatgctatcgttattgaatatcaagaaaataaactttgattcagacattcaaaaatcagaaactttgaaaaaggttttattagatagtttagcagaaccattttttgaaaactacaagaagttccctcacaaagatttaggttcgaaatcgcaatataatgaatatgaggagaaacacgatgatatagtctccttagcagacatcaaaccacaacaggactatagccgaattcttcatcctttcacatctgcaaaaaattctggtccagaggccatttttacatgttctcaacaatacccctggaacttcaaagctgccaatgatttggcgtgtctaacgttcggtatatcaaagaatgttatcaaggcacttactttactagaccttattcatacggatagcagaaattttgttctagagaaaatcatgaatgcagaagatgataaccaagaaattgtgtttaccggagaaactatacctatcgtccagccaaattcgacaagcaataataatgtaccaaatctgatttgggcttcactatgggccaagcggaagaatggcctactggtctgcgtatttgaaaaaacgccttgcgattacattgacgtcatgttaaacttgagagatttttcagtggacagcattattgatacaacacactttctggaaaactttgacaagaaaaagcagcaagaatcaacttcgccaatgacagaaaagaaaacggtaaaatttgcaaatgaaattcacgatattgggtcagtaagtcactcactgagtaaactaattgatgatgtacgttttggaaaagtgttttctgcagatgatgatttattacccttgtctatcagggtggcaaatcatgtcaacgaagagagatattttacgttgaattgtctatctgaaaatataccatgtgctgttacaacttccgtattggaaaacgaaataaaattaaaaattcatagtttgccctatcaggctgggctatttattgttgacagtcacactttaagtcttttaagtttcaacaaatcagtcgccaaaaacatgtttggcttgcgacttcacgagttggccggtagttcggttactaagttggttccttctttggcggacatgatatcttatatcaataaaacttatcctatgttaaatatcacattaccagaaaataaaggattggttttaacagaacattttttcagaaaaattgaggctgaaatgcatcatgataaggactcgttttacacttctattggtctagacggctgtcacaaagatggtaatttgataaaggtggatgttcaattacgggtcttgaatacgaatgctgtattattatggattacacactcaagagacgtggtcattgaaaattataccaccgttccttcgcagctaccgatgttaaaggagaacgaaattgatgtcgttggcagtagaggtagttccagtgcatcttccaagaaatcttcggaaaaaattcctgtgaatactttgaaggcaatggctgatctgtcgattagctccgctgaaacgatttctaattcagacgatgaagtagacttaaatcaagtgaatgaaaaactacgagaaacttcttgcggtaaagtgagaggtatcgaatctaatgacaacaataactatgacgatgacatgacaatggttgatgatcctgagttaaaacataaaattgaattaacgaaaatgtacacgcaggacaaatcaaaatttgtaaaggacgacaactttaaagtggatgaaaaatttataatgaggataattgaaccgataaacggagaagaaatcaaaaaggaaacaaatgagctagacaaaagaaattctactttaaaagctacgtacttgactactccagaggctaatataggctcacaaaagcgcataaagaaattttctgattttactattctgcaagtgatgggtgagggtgcgtacggtaaagtcaatttatgcattcataacagagaacactatatcgtggtcatcaaaatgattttcaaagagaggattttagtagacacatgggtgagagatagaaaattaggtactataccttctgagatccaaattatggcgaccttgaataaaaattcccaagaaaatatcttgaagttattagatttttttgaagatgacgattattattacattgaaacaccggtccatggagaaactggtagtattgatctatttgatgttatcgaattcaaaaaagatatggttgaacatgaagctaaactggtgtttaaacaggtagtcgctagtataaagcatttacatgaccaaggaattgttcatagagacataaaggacgaaaatgttattgttgattctcatggctttgtaaaattaatcgatttcggttcggctgcctatatcaagagtggaccattcgatgtttttgtgggaacaatggactatgctgcacctgaagtccttggtggttcctcttacaaaggtaaaccacaagatatttgggctcttggtgtgctactttataccataatttataaagagaatccttattacaacattgatgaaatcttggaaggtgaattaaggttcgataaatcggaacatgtcagtgaagaatgcatcagtttgataaaaagaattttgacaagagaagttgataaaagacctactattgatgaaatatatgaagataaatggcttaaaatctag

SEQ ID NO: 176 - DNA, 2487 bp, Saccharomyces cerevisiae
atgttgggtaatttactgagaaataagacgagttcgtctggttttgagaagagctcagagcattccgatttttcctccgtagttcccaatgtccctgtatactgcaaagcggcaagcacaggaactactaagaccgctgctggagctcttttagatactgcagtcaatgtggaaaagccttcggaaatgctatcaacgacttctccgcccattttagatcatatatcggatgacttaaaactgaagcttttcggctcgagggatattccttatagtcgtcctatcgatacgttacaaaacaacggaggtcttggtactgataaaatcacgtctattaacgaaaaaacgtatgcattcaggattttgatcattgaggaagcgggtcaaatggcgtgtaggaacaactaccgtgatatcttcgattacactacgtcaaagatttcaaattcgatggagcagatacggccgagtgaattgaaggaatatatatttggttctcccgtaagatcttccgatttgacgcagtgcgacaagataaggacgattcctaactcggatttggtactcataactagaattttctattacacacaccaatacaaccgcatcgcaattagcttatgcataccgaggatattgttgcccgtagttgcagagtcgtggtcttccatttcatcatggttgacccagactcaaaaaatgctcattggtttcttgactaaaaaccgtattatgcaagaaaatactggcaattacagcaataattcagtcataaaattgtcaaatattgacatcaggacgcattatcccaaggaaattgaaataatggtgcaaactttacaaaaaagagtcataccaggtttacgttctatgtctgagattcctaggcttttcctttaccctgagacatttaaagaattcgttcacgtttggttcaaaagtatatttaattggattgaaatcaaagatggaccgaaactaggcttccttcctctcctaatggcaatgattatatctgattacaggcacactataagagaactaaagacatccaagatcgtaatcctgtcaggaaacatggtggttgctaacaagttactgttcatcttatcggctttattggagccaaagtacaagggacaaataacgatacggcgggaaaacataagatcggattcgtccgctgtatcaagaaataagtctaacaataattttgtcgataagcctgagacggaattgagcacactgacttcaacagacaaccttttgagtcgcacagaaaataatagcaatcataattacaacaacagtaatgtgagctctaacagcattggatcacccaatttccattctttgaggaaaggatggcaaatacccaatcggaggaactcgaacacttcagtatctgtgtcttctagtgagtctttagcggaagttattcagccatcttccttcaaaagtgggagtagttcattgcattatctatcgtcttctatctcaagccaacctggttcgtacggttcttggttcaacaaaaggccaacaatttctcagttctttcaaccaagcccttctttaaaacacaacgagtcgtgggagaggctgcaaacaactgctggaaatatgcaaaggacttcaagttcgtcttctttgcagcaagcaacctccaggttatcactaaccactccgcaacaatcaccgtctatcagcgaatatgatgagtatccttggatgggcacacctggctctcctaatgttggagatgtgtctcacgcacccccattggttaagaatatatcatataaatttccactaaagaacgttgagttgaaaagagattgccaaaggatctctcaggatgatcttttggatgaggcttttgaaagaatatgtcagccctctttggctgaccttaattccacttacgaaatttttccaggtaactcttcttatgcggatattttgactactgattctgatattgatgatggcttgatgaataaacctctggaactattgccgaaatatacaatgtatttaacccattttaacaattttttccagttgcaagcatgtcctgctggtcaagaatcagagagcagaataacaaattctatgaagattgacctgttaaaggcggattacacaagaagtctattagtatcgttacgttcaagggacattagggatgtcgcattgaaaagagagtttactggcaataacaacaataacagcaaccagaatatctatgatgagaattttgtcggaaaaaggaagtacgtgttgaaacagaagaccagaaaaatcttttcctgtggcaagattggcaagctaagtactagtttggaaaactgcgttaattttgttgaaaatagtataaagagtgcaatgatgttatatgatgataatggaatagatagtgagcttcgcgattcagaagctttacggattttttcatctcttgttcattattgtaatgcaggttaa

SEQ ID NO: 177 - DNA, 393 bp, Saccharomyces cerevisiae
atgggcacggacttcagtgcctcccattgtgccaactgctctgcagttggctttatcttggagcccgcctgtgaaccctgtaagaggtctactttggactggcccggtggagccagcgaggtctctggcaggtattcttttgcagagaactcttcccttagctcgttgatcgcttcaagccactcgtcgacccctttctctgccgatggttcgctagctggtgttcgtactgacgactggaaacgagcaacacatgtcccactttgccacaggagacgtggcctgactaacatatacctcctcgcacaatgcagcattatattcacctcagatccgtatctatctatttttcttctgaaaacgatagctgctgtcttttctgtacgtgtataa

SEQ ID NO: 178 - DNA, 2304 bp, Saccharomyces cerevisiae
atggttcaatctgctgtcttagggttcccaagaatcggtccaaacagagaattaaagaaggccactgaaggttactggaacggtaaaatcactgtcgatgaattattcaaggtcggtaaggatttgagaactcaaaactggaagttgcaaaaggaggctggtgttgatatcatcccatccaatgacttctccttttacgaccaagttttggatttgtctttgttgttcaatgtcattccagaccgttacactaagtacgatctatctccaatcgacactttgtttgctatgggtagaggtttacaaagaaaggccactgaaactgaaaaggctgtcgacgtcactgctttggaaatggttaaatggttcgactctaactaccattacgttagaccaactttctccaagaccactcaatttaagttgaacggccaaaagccagttgacgaatttttggaagccaaggagttaggtattcatactagacctgtcttgttgggtccagtttcttacttattcttgggtaaggctgacaaggattctctagatttggaaccattgtccctattggaacaattgttgcctctatacactgaaatcctatctaaattggcttctgctggtgccactgaagttcaaattgacgaacctgtcttagttttggacttgcctgccaacgcccaagccgccattaagaaggcttacacttacttcggtgaacaaagcaatctaccaaagattactttggctacttacttcggtaccgttgtccctaacttagacgccatcaagggcttgccagttgctgccttacacgttgactttgttagagctccagaacaatttgatgaagtcgttgccgccattggtaacaaacaaaccttgtccgttggtattgttgatggtagaaacatttggaagaatgatttcaagaagtcttccgctatcgttaacaaggctattgaaaagttgggtgctgacagagtcgttgttgccacttcttcttctctattgcacacaccagttgatttgaacaacgaaaccaagttggacgctgaaatcaagggctttttctctttcgccactcaaaaattggatgaagttgttgtgatcaccaagaacgtttccggtcaagacgttgctgctgccctagaagctaacgctaaatctgttgaatccagaggtaaatccaagtttatccacgatgctgccgttaaggccagagttgcctctatcgacgaaaaaatgtctactagagcagctccatttgaacaaagattgcctgaacaacaaaaagtcttcaacttgccattgttcccaacaacaactattggttccttccctcaaaccaaggacatcagaattaacagaaacaaattcaacaagggcaccatctctgctgaagaatatgaaaaattcatcaattctgaaattgaaaaggtcatcagattccaagaagaaattggtttggatgtcttagtccacggtgaaccagaaagaaacgatatggttcaatacttcggtgaacaaatcaacggttatgctttcactgttaacggttgggttcaatcttacggttccagatatgtcagaccaccaattattgttggtgacttgtccagaccaaaggctatgtccgtcaaggaatctgtttacgctcaatccatcacttctaagccagtaaagggtatgttgactggtccaattacctgtttgagatggtctttcccaagagacgatgtcgaccaaaaaactcaagctatgcaattagctttggctttgagagatgaagtcaatgatttggaagctgccggtatcaaggttatccaagttgatgaaccagctttaagagaaggtttaccattgagagaaggtactgagagatctgcttactacacctgggctgccgaagctttcagagttgctacttctggtgttgctaacaagactcaaatacactctcatttctgttactctgacttggatccaaaccatatcaaggctttggatgctgatgttgtttccatcgaattctctaagaaggacgatgctaactacattgctgaattcaaaaactatccaaaccacattggtctaggtttattcgatattcattctccaagaattccatcaaaggatgaatttatcgccaagatttcaaccatcttgaagagctacccagctgaaaagttctgggttaacccagattgtggtttgaagactagaggctgggaagaaactagattgtctttgactcatatggtcgaagccgccaagtacttccgtgaacaatacaagaattaa

SEQ ID NO: 179 - DNA, 816 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttgcatgtgtgctgcccaagttga

SEQ ID NO: 180 - DNA, 1965 bp, Saccharomyces cerevisiae
atgccaaataatactcttaaacaaggctccaaaattgaaaatgtttctccctctaaaggtcatgtcccaagtttttggaagcagttcataaacaaccctaagagtatgtcatccgaaaatattacagtccctagatcaccaacttctctttcaaggaatgctcaaccaactactttaaaacggcctccattatcttcaagaccatattcatataataccccaaccaaagataggaaatccttttccaaatccgcgaaacagaacaataacaataacaacgctaattccggaacatcgcctcacgcagagttcaaaaattacagagatatgtttttatctaatagaaatggtttcacaggtagggttttcggtgttactttagcagaatcgttgagcgtcgccagtgcagaggtcattgttcaaagtgagttggtgagttttggtcggatacccatcgtggtagccaagtgcggcgcatacttaaaagcaaatggattggagacctcgggtatatttcgtatagcgggcaatggtaaaagagtaaaagcccttcaatacatattctcgtcgccacctgattatggtaccaaattcaacgattgggaaacatatacagtgcacgatgttgcatcgctcctgaggagataccttaataatttggccgaaccactaatacctttatccctatatgaacaattcagaaacccgctacgatctagaccaagaatcctaaggcatatgttgacccacgaagtttctcatccgaatgcgaataaaacaaataatgtaacagtaaaatcaagtagacagaactataatgatgatggtgctaatgatggtgacatcgaaaaggaggacgctaaagatgatgaagaaaaaagacgaagaaaaatacgtcataagagaaggctgacccgcgatataagggcagctatcaaggaatatgaagagctctttgttaccttatcaaatgacacgaaacagctaactatatacctactcgatttactgagtctttttgcaaggcaatcacagtttaacctaatgtctggtagaaacttggcggccatcttccaaccttcaatattatcgcatcctcaacatgatatggaccccaaagaatacgagttatcccgactagtagtggaatttttgattgaatactcgtacaagctattaccccatcttttgaagttggctaaaagggaacaacaggaacggttgtcaaccgaaaataagaaaaataatggagataaacagaaaactgatcctatagaaataccaaagatcacctcatcggattcgccaccaatagtttcttccaataaaaacccaccggcgattgacaataacaataaactagaccatacgacgttatcgccaatatctacttcgataccggagaactcatcagacctacagacttcaaaaatgttaaagcctccgaagcaaagaagaccacactcaaaatcgtttggttctactccggttcctccggatgttattgctagtaataaaagaagaacgagtttattcccgtggttacataaaccgggaattttgagtgacacaggagacaatggcgacttaactgctactgaagctgaaggtgatgattatgaagaagaaaatgttgatccatacggtcagtctccatctagcgtacactcaggttctttgcccaaacagcattatctgccaattcctcgaatgaacagatcgttgagtggaaacagtaccaattcgtcctttaacactagacctatttcaatgatcctgaccagtggtaatgataattccgctgatcaattagaattactaagtaacactcatagcaataatgagcgcagtaatgctttaccattaaccgaagatgatggggatgaaagaaattcaagatcacgcaagagggaatcatggtttcaaagactaacaagccgttcaggctctgctaacagggcttga

SEQ ID NO: 181 - DNA, 669 bp, Saccharomyces cerevisiae
atgaagtttttcccactccttttgttgattggtgttgtaggctacattatgaacgtattgttcactacctggttgccaaccaattacatgttcgatccaaaaactttgaacgaaatatgtaactcggtgattagcaaacacaacgcagcagaaggtttatccactgaagacctgttacaggatgtcagagacgcacttgcctctcattacggggacgaatacatcaacaggtacgtcaaagaagaatgggtcttcaacaatgctggtggtgcgatgggccaaatgatcatcctacacgcttccgtatccgagtacttaattctattcggaaccgctgttggtactgaagggcacacaggtgttcactttgctgacgactattttaccatcttacatggtacgcaaatcgcagcattgccatatgccactgaagccgaagtttacactcctggtatgactcatcacttgaagaagggatacgccaagcaatacagcatgccaggtggttcctttgcccttgaattggctcaaggctggattccatgtatgttgccattcgggtttttggacactttctccagtactcttgatttatacactctatatagaactgtctacctgactgccagggacatgggtaagaacttgttgcaaaacaaaaagttctaa

SEQ ID NO: 182 - DNA, 1563 bp, Saccharomyces cerevisiae
atgtcatcaagcgaaaacacgttactggatggaaagtcagagaacacaatacgatttttaactttcaatgtcaatggtataagaaccttttttcattatcaaccattttctcaaatgaatcaatcccttagatctgttttcgacttttttcgagcagacataataacattccaagagctcaagacggaaaaattgtctatctctaagtgggggagagttgatggtttttattcttttatttctatccctcaaaccagaaagggatattctggcgttggctgctggattagaattccggaaaagaaccacccactataccatgcattacaagtcgttaaggcagaagaaggtataacgggttacttgacaataaaaaatggtaagcattcagcaatctcctatagaaacgacgtaaatcaaggaattggtggttacgattctttagatcccgatttagatgagaaaagtgcactggaactagattcagaaggcagatgtgttatggttgaactggcatgtggaatagttattatcagtgtatattgtcccgcaaattcgaactcatcggaggagggtgagatgtttagattaaggttcttgaaagttttattaagaagagttcggaatttggacaaaattgggaagaagattgtgctaatgggcgacgtaaatgtttgccgggatcttatagacagtgccgatacattagaacaattctcaattccaataacagatcccatgggtggaacaaagttagaagcacaatatagggataaagcaatccaatttattatcaatccggacacgccacatcggaggatatttaatcaaatattggctgattcacttttaccagacgcgagtaaaagggggatactgatagacactacgaggctaattcaaacaagaaatcgacttaaaatgtatacagtctggaatatgttaaaaaatttaagaccttcgaattatggctcacggatagattttatcctagtgtccttaaagcttgaacgatgcataaaagcagctgacattcttccggatatattgggctctgaccattgtcctgtgtattctgatttagatatactggacgacagaattgaacctggtacgacacaagttcccataccaaaattcgaagcaaggtacaaatataatttaagaaaccataatgttttagagatgtttgccaaaaaggatacgaataaagaatctaataaacaaaaatattgtgtatcaaaagtcatgaataccaaaaaaaacagcaacatcaaaaacaaatcgctcgactcatttttccagaaggtaaatggagaaaaagatgacaggattaaagaatcctctgaaattccacagcaagctaaaaaaagaatctccacgccaaagttgaatttcaaggatgtctttggaaagcctcccctgtgcaggcatggggaggaatccatgctgaaaacatcgaaaacttcggccaatccaggtagaaagttctggatttgcaagagatctcggggtgattcaaataatacagaatcatcttgtgggttttttcagtgggtttaa

SEQ ID NO: 183 - DNA, 1770 bp, Saccharomyces cerevisiae
atgactatttcttctgcacatccagagacagaaccaaagtggtggaaagaggccacgttctatcaaatttacccagcaagtttcaaagactctaatgacgatggctggggtgacatgaaagggattgcctccaagctggagtacatcaaagagcttggtgccgatgccatttggatctcaccattctacgactcgccacaagatgatatgggttacgatattgccaactacgaaaaggtctggccaacatatggtacgaatgaagactgctttgccttgatcgaaaagacacataagcttggtatgaaatttatcaccgacttggtcatcaatcactgttccagcgaacatgaatggttcaaagagagcagatcctcgaagactaatccaaagcgtgactggttcttctggagacctcctaaaggttatgacgccgaaggcaagccaattcctccaaacaattggaaatcctattttggtggttccgcatggaccttcgatgaaaagacacaagaattctacttgcgtttgttttgctccactcaacctgatttgaattgggagaatgaagactgtagaaaggcaatctacgaaagtgccgttggatactggttagaccatggtgtagacggctttagaattgatgtcggaagtttgtactccaaagttgtaggtttaccagatgctcctgttgttgacaaaaactcgacttggcaatccagtgatccatacacattgaatggaccacgtattcacgagttccatcaagaaatgaatcaattcatcagaaacagagtgaaggatggcagggagattatgacagttggtgaaatgcaacatgcctccgacgaaactaagagactttatacgagtgcttcaagacacgaacttagtgagttatttaacttttcccacactgatgtggggacttcacctttgttccgttacaacttggtcccatttgaactgaaggattggaagattgcccttgctgagctgttcaggtacattaatggtacagattgttggtcaacaatctatctggaaaatcacgaccaacctcgttcaattacgagatttggtgacgattctcccaagaaccgtgttatttctggtaagttactctctgtgttgctaagtgccttgaccggtactctatatgtgtatcagggacaagagcttggccaaatcaatttcaagaactggcctgttgaaaagtacgaggatgtcgaaatcagaaacaactacaatgccattaaagaagagcatggggaaaactcagaggagatgaaaaagtttttagaagccattgcccttatctccagggaccatgctagaacacctatgcaatggtctcgtgaggagccaaatgctggtttttctggtcctagtgctaaaccatggttttacttgaacgactctttcagagaaggcattaacgtcgaagatgaaatcaaggatcccaactcggttttgaacttctggaaggaggccttgaagtttagaaaggcgcataaagacattactgtgtacggatacgatttcgagtttattgatttagacaataagaagttgtttagcttcacaaagaagtacaacaataaaacattgtttgcggctttgaactttagctctgatgcgacagatttcaagattccaaatgatgattcatcgttcaagttagagtttggaaactatccaaagaaggaggtagatgcctcttccagaacattgaagccatgggaaggaagaatatatatcagcgaatga

SEQ ID NO: 184 - DNA, 2196 bp, Saccharomyces cerevisiae
atgtttagagtatttggttcatttggatcaaagggtaatcaatcttctggtgaagagcaatcaacaaagacaaaacaggttctgaagcaggctaatgactttgagatcgccttaaaggcaatggattttgtccttgatgatagaacggatgaagggttgaatttgctgaaaaaagctgaaatggaaactggttcagatcaaactatcttgactttggcaagaggtgttattgaatttcttcaagccactttgagttttgaaactgaagaaatgaaaagagctgcaattactttaggcaaagctgagcaaatgtcctggaaaagtaagcaaaatgctgaaaagaccaattttaggagcagttcaatatatcctcccggtactgtctatgctgtaacatatactgagtcatgtctgttgcatgccttgttgatgttatttagtgaaagcatgatggaagcagccaaggctttgctaaagttaaggagggcttatacaatgttacaagatatcatggttactgtcaaaaaagctgaacgatcgaaaaattcgagctctccctctccaagcgaaaagagccaagagtcatgcggaagttttgtttctgcagagacaactttcatatcggttgatataccatacaaattgtcttccgaggacaagtccaatccactcctattggaatttgctgaaaaaatctacacgatgagaatgggaaggttatcaggtgcccatattggcaatactccatcttttcataggttaagggatgatttgggtttacagacgactccgtctcaagcttccgaccgccattctgtttcagatgatttcgatttagaacaggctaccatcgacgaattcatccattcaggtgctaatttatgctatggtatcttgcaagtcgtcttatccttacttccacctgcaatcggtgctgtgctatctattgttggattcaagggatcccgtgaagaaggtttgaggctagtttggaaggctacaaaggagagaaatgttcacgggtgtataggtttgttaggtctgatgttttattacgacggtcctttccaatttacagatgctgactttgatataccaccaaacgataatggatcgagggctttaaacaaaagcagaacaaacgatagtagccttttaccaggttatatggacagtgcaaccttattgcatcctggaaaaattctggaggacgcattactaaaagcaagagcactttttcctaatagtgccctgtggctgctaaatgaggccaaaatgcttgctggaaagggcaggcttcgtgattctctggccctaatggactctattgatgtcaatagtatccgtatgagacaagtgaaatcgttgatggtgtttgaacgtgcgatccttttagtcaacttacacgaatacaacagagctgccgatgatttaataagtttgcttgatattagtgattggtctcacgcattgtacacttattttgcgggttgctgttacttggaaaattggaggatgacacaattaggcttattaaatgacggtaaagaacaattctataaagagcgggctcgagaactcatatttgacgctccatctttgttaggtaagaaaacgttcaaatccaaaaatcttccattggatagattcatgcttagaaaagttcaacaatttaataatatgcagaagaaattaaacctacaagaaccactagactcaatagcaacatcacctgtccatgaactggcttatttctacaacggttacaacaggatgactgaaaacgatttaattttgaccaaaaagatgttgacagagtatcacaaccccgccattgattcggaagacccagatcaagagctgatcagaaacttactactatccttgaccttaagaagattgggggatgctgaaagaggtttagccttgttagatgacattgttctgccaaaaatattctacattcaaaatggcaaagtcaaatatttcaaaaaaaccgaagacccatgggcatatccagccgctctttatgagagagctttattctgttggaaactgggtggcatggaaagtttgaatgaatgtagggaatggctgctaagagcccaaaattatgccgccgattacgaattgagtacgcgtatcggtatgaagatcaaagccgcccttgatagagttgaaaacgcgcttgcttaa

SEQ ID NO: 185 - DNA, 2790 bp, Saccharomyces cerevisiae
atgtctcagcagaatattttggcagctagtgtttcagcgctctctcttgatgaatctactgtgcatacgggcggagcatcttccaaaaaaagtagaagacctcacagagcatatcataacttttcctcgggcactgttcctactttgggcaattcaccctacactacaccccaattgaatcagcaggatggttttcaacaacctcaagcctttacccctaagcaatttggtggcttcaacaacggttcgggttccgttatgtccacgcctgtaatggtgagtcaagagcgattcggtgcgagtgaggcctcctcgccatatggtcaatctatgcttgatatgacagcgcctcaacctacatctcacattgttccaactcaaagatttgaagatcaagctcaatatttacaacgatctttcgaaacttgtagagattctgttccgcccttgccgaccacccagttttattgtgttgaccaaggttcatgtgatccgcacttgatgagtttatccatgtacaacatccccgaaagtgaacacttgagagccgccacgaagctaccacttggattaaccatccaaccattttccactttgacaccgaatgatgcagaagttcccacaattccattaccaatggatggtacgcctttgcgttgtagacgttgtcgtgcgtatgctaatcctaaatttcagttcacttatgattcaagtgttatttgtaatatttgtagagttaagatgcaagttccaggtgagcattttgcgcccatgggtcccaatgggcaacgaagtgatttgaacgaaaaatcagagttattgcacggaacagtcgatttcttggtgccaagtatttacaatgctattcaggagaaggagcttttaccactacactacgtgtttttgattgatgtttcattgttagctaatgagaacggaagttctttagccatggtggaaggtgtcaggtcatgtattgagtatatttcagatttccagccaaattgtgaggttgctataatcgtttatgataataagttgcggttctttaatttgagaccagatttagataatgcacaagagtacattgtaagtgaattggacgatgttttcttaccattttataatggattatttgttaaacccggaaactcgatgaaaatcattaatgacacattgataaaaattagtggttacatctccaccgacaagtatagtcacgtaccccaagtctgttatggttctgctttacaagccgcaaaattagcgttagacacagtaactggcgggcaaggtggtaagattatttgttctttgaacagcttgccaacgatcggcaacgggaatttatcgctaaaaagggacaatgcacacattgctcatgttaaatgcgacaatgggttctataagaaattagcatcggattttttgaaatcctacatttctttagatttatatgtgaccaatgcgggattcattgatatggccactgtgggccatcctgtagagatgacttccggtattttgaaatattatccccactttcaacaagagacggatgccttcactttggttaacgacatggttacaaatgtctccaatattgttggttatcaagctttattgaaagttcgctgttctactgggctatctgtggaacagtactactgcgattcatctgataatacggatcatgatccaattattcctgtattgactagagataccaccttagatgtcttactaaaatatgacagtaaaataaaaacaggaaccgatgttcatttccaaactgcattgttatatactgatattgatggtgtcagaaaagttcgttctattaacacgtcaggtgcggtatctaataacattcgtgaaattttcaagtttataaatcaaaatcctgtcatgagaataatgatcaaagatgtcataaagacgctcggtgattgtgactttgtaaagatcagaagattaattgatgacaagatggtcgaaatcttgacccaatatagaggattggttagcagtaactcatcaacgcaattgatactgccggattctataaagacattgcctgcttacatgttagcatttgaaaaaagcgaattaatgaagccaaacgctcaaagtacccgtggtaatgaacgaatttatgatttattgaagtacgattcattgaactcagcacaactttgctacaaactttatccacaaattgtgccattccatgtattattagaggaaactgatctgaccttttacgatgctaatgataaattattacagatcaactccagctctattaataatctatctgtaagagcctcacactctaatttcattaacggcggttgctacttgattttccaaggtgatactatctatctatggtttaatgagaacaccaatagaatgctcttgcaagacctgctgtcagtggatgaatccttgcccgtcagccaaatttcgttatttagtggaacattgcctgagacgggcactagtattaatcaaaaggcttcaaacgtcattaaaaactggcaacaagtagtcaacaagtcatcattgccgttagtcttgttgaggcctaatgttgatcaatattacagtaatgtgatgagtcaattgctttgcgaggacaagaccgtcaacagaatcgaatcatatgacaattacttggtgataatgcataaaaaaattcaagaaaaacttcaaaaagacgatttcattaaagtctcgactgccgcaactcacgaaaatatccatcaaaaatttgtgcagttttga

SEQ ID NO: 186 - DNA, 2694 bp, Saccharomyces cerevisiae
atgcctcaagcaagcacattcggatcgcacagtctagaagctcatcccttacacattcagccagctgttcatatcaaactcagtaaagaggaaaggtctcactacagggagcaatacgattcattaaagtatatttcaaattatgtttctgttttcgaccaagcgttaagcgacaatattgactctaggattagaaaagaaaatgaagccttactgaaaaaatattatgaatcaagaaaaccttttacttttaccagctttaggcaaggaagtgtaatcagttcttctgattcttctacaggcttcactgagagaacaaagacctactgttttttgaacgatttcgtcagtaattgcgtaaatgaggtagatccatatacgctgaaaatgacagtaagaaatagaaacactgccttgaatatggagaacctcgatgatgaacgtaagagcaaagatgatatatacgattttgaagataatactgacgacgagtgtaatgccaagtgccatggtgctttccattattcgtcagaaagattggaaattcttcgctcacgttcgacaatatcgtactttaagtattataaaaagcttttgacggtagacctaagggacagtgatgttttaaaaaggcataatttatggatgccaatgatcactagaagatttagatttttattagtatcaagttcgaaaccggaagatgtaaggttaacaacgccgattccaacattctcggaatcagatttagacattttcaagaacaagacatgtccactctttatcaatggtacagactgtgttcctagaagttatgacactttttcgggttcttctgtaatcgcttcaatattttcagaatataaacttccatccctttcatatcattgttctgtcgagttgaacgaccaattatttattgtcggtggtttgatggcatgtcatagatatgatgaggaagcgcctgatctaaaggatttttacgtggatggcataaagaatttaccgccaccactaataccagagctaattaataacccatccatgattcctaatcctcacttgtactgtttttccttgacttcttccagactaacaagacctgatatttctggttacattccgcccccactggtgtgcacccagggctgtaaattaactgaaaggcatatctttttgtatggcgggtttgaaatcaagtcggaaacccaagttgatgataagggaagatattttataagaaaaagagcttttttgaacaatactggttacattctagatacagtgacgttcaatttctcaaagattgaattagtcgctcctccgtaccagtttgcaatttacaataatttctcgccaagatttggtcacatgcaggcatcaataagtaattccaacaacaatgtatccaatgaaaataccacaacaagtgcgaaaggaagaaggtcgataagcccatatcgccaaggtaatggggatcacaaaatagatgatttggttggttcaccaggaagtacggactatttagaggatgatgcaattccacctgtaacaaacccaaggtctacagatagtctctcttccaaacattgtagcacagcaacacacatttgctcatctgttaataccattctgatctttggagggtatagtcagactggtgacgacaagtatgaagctatgaatgacatgtggaagataaatatccctgtagtttctcgtgggaaacgtaattattataaatttgcagatactgtaactgctactaagatccctattattgatgatccagaattatggccgagcagaagagccttttcagcgtgctgtgtaccagattattttaccaaggatgttgaacccatagaaacgagattactgaggaacttgaaaaatgacttctccatcgatttggaaatacgcccaggaaataagccttctcaaccactttttccgaatatcccacattcaaggaaggagaagaagagtggtcgcgatagtatgcatatttccaattctaataatagtactagtgaagacacttcttcaaagtctaccaggaataccacatccagtcctcccacaagccctaaacatacaccaccattgaatccatcaaaaaaatgtgcatcaatcggaagaactattgcgttccacggaggttcagatggctatgacgtttgcagcgatatgtggtggtttgacttcgattccgaaacctggactaaaatagacctttatgccaaaacacaagaggaatctgatggtttggtacctatcaacttatgtatggtaggacactcaatgacaactgtaggccacaaggttgtgcttatcgggggtctacgacaaggtgatgttgaccgaatataccgggacgaaactcttcctgaagaagtaatatcgggtgttccactcggaagtggcgttataaatgtcgtggatttaaatacacaatgccttcaaggttgcaagctaatacgaaatgatggagatactaaagaatctgtcattatggatcctcatgtcggcacaccccaccaagtattggccgtcgcaggtactatagaactggtcaaaggaaccatgaccttaataggaggtgtagtagccggtcgcgaagacatttcgagcctttacttgagaggagctgtcttacaattcattctaccaagcatgaatctagccaactaa

SEQ ID NO: 187 - DNA, 978 bp, Saccharomyces cerevisiae
atgattgaagagaatttgaaacagaaaatccacgataagttcgttgcagccaaaaagaatgggcatctgaaagtaacgcatgcagaatccaagaagttgaaagatcctcaaacgacgacacaatattgggtgacatttgctccatctttggcacttaagccagacgctaacaagaatagcgattcaaaggcggaggacccgttcgccaatcccgacgaagaactagtggtgactgaagatctaaatggtgacggagaatataagctgctactcaacaaatttcctgtggtccctgaacatagtctcctagtgacaagcgagtttaaagaccagagatctgctttgacgccaagtgacttgatgactgcttataatgtgctctgttctctccaaggagacaaggacgatgatgtcacttgtgaaaggtatctggtcttttataattgtggacctcatagcggttcctcacaagatcacaaacacttgcagatcatgcaaatgcctgaaaaatttataccttttcaggacgtattgtgcaacggaaaggatcatttcttgcccaccttcaacgcagagccattacaagatgataaggtttcctttgctcatttcgtcttgccgctgccggaatcgtctgatcaagtggacgaagatcttcttgctatgtgttacgtatctttgatgcagagagcacttacatttttccaagattggaccaatgagtctccggagttgaccaagtcatacaatgtgctactgaccaagaaatggatctgtgtagttccaagatcgcatgccaagagtggaccgccattgatgttaaacattaactccacggggtactgtggtatgatcctcgttaaagacagagaaaaactagagaacctcactgaagatcctcatcttgtggacaagtcgttactgcaatgcggtttccccaacacagcaggccaaaaaccaacagagtatcactattaa

SEQ ID NO: 188 - DNA, 648 bp, Saccharomyces cerevisiae
atgttcgaaattaaactgaatgatagaataactgaatttctgcgaaagttcaagaatagcgcgaaatcaaacgaaggaattgatgaggacattgatttgttcctgaagcgacacgcaatacctatgcagtcacttcttttttatgtgaaagagtatagaaaagacagtgatctccaatgctctatcaaagaacttttgaaacctttggagttcgaattcaagcccaaggccgtcagaggtttacactattcagaggatttcaagaaaaaattagagtttttgaaatatcaggaacaagaacttgaatatcaaagtatggtcaagagaagcaagtctgtcttttcacttcaagaagacgatgaactcacgccttcacaaattaataaacagattaaggaacaagttaccactgttttcaacgttcttgtaagtgtcatatcggttgttgtggccatttggtactggaccggatcttcaacaaactttccggtccatgttcgtcttttgttgtgcttgttctttggaatattggtcttagtagcagatgtggttgtgtataacagctatctgaaaaaactcgaagaagcaaaagtaaaagaaaaaacaaaggttgagaaaaagaaagttctaagcaagattacactgtaa

SEQ ID NO: 189 - DNA, 1980 bp, Saccharomyces cerevisiae
atgccttcttctttgacaaaaaccgaatctaactcagatcctcgaacaaacatacagcaggtaccaaaagccttggacaaaaatgtaactaatagcggcaacttggattcgacttcttcttcgacagggtcaataacagaggacgaaaaaagatcagaaccgaatgcagattccaataacatgacagggggcgagccaattgacccaagagatctcgattgggacgggcccgatgacccagacaatccgcataattggtcctctttgaagaaatggtatactactatgacttcagcttttctttgtttggtcgtcacaatgggtagttccctatatgtttcttccgtaccagaattggtagaaagatatcacgttagtcagactttggcgcttgctggtttaactttctatcttctgggtttatcgactgtcatcggcgctccattaagtgaagtgtttggtcgtaagcctgtctatttattttccctacctgtgtcaatgcttttcaccatgggtgttgggttatccaatggccacatgagaataattctacccctaaggtttttatcaggtgtctttgcatcccccgccttatccgttggatcaggtaccatcctggatatctttgacgtggaccaggtctccgtcgcaatgacatactttgttctatctccattcttagggccagttttatctcctattatggcaggatttgctactgaagccaaaggctggcgttggtctgaatggatccaattgattgcgggcggtctaatcttgccatttattgcgctcatgccagagacccataaaggtattattttaagaaagcgtgccaagaagagaaatatagccttgaagaagttcagcagggaagctcagaaagaatttttaaaaaccactgtcactattacaatcttaaggcctttaaaaatgcttgtcgttgaacctattgtatttgttttcagtgtttatgtcgctttcatattcgccattttatttggatttttcgaagcatacgctgtcatttatcgtggtgtttaccacatgtctatggggatatctggcttgccatttattggtattggtgtcgggttatggataggtgctttcttttacctttacatcgacagaaaatatctcttccctaaaccaccagctggcactcaaccactcaccgaaaaagagagaacttctaaaaggactaccccttacagaggtgcaagagacgctgaaacaggtgaattgctacccgttgttccagaaaaatttttaattgcctgtaaatttggttctgtagctttgcctatcggcctgttttggcaagcctggactgctagatcagatgtccactggatggctcctgtggctgccggtgtgccatttggttttggtttaattttgatttttttcagcgttttaatgtacttctctacatgctatccgccattaactgtggcatcctgtttggctgccaataatctattaagatacgttatgagtagtgtattcccattgtttaccatccaaatgtacacaaagatgaaaatcaaatgggcaagcactttatttgcattagtttgcgttgtgatgattccaattccatgggtttttgaaaaatgggggagcaaattaagacacaagtcacaatttggttatgccgccatggaaaaggaggctgagaccgaaggtggtatagatgacgtaaatgctgtcgatggtgaattgaatctaacaaggatgaccacgttaaggaccatggaaacagacccttcgactagagaaaaaccaggtgaaaggctatctctgcgcaggacccatacgcagcccgttcctgcctcgtttgatcgcgaggacgggcaacatgcgcaaaatcgtaatgaacccatttccaatagtttatactcagctatcaaggataatgaagacggttattcgtatacggaaatggccaccgatgcttccgccagaatggtttga

SEQ ID NO: 190 - DNA, 1668 bp, Saccharomyces cerevisiae
atgtataatggcaaggatagagcacaaaactcctatcagccaatgtaccaaaggcctatgcaggtacaaggacaacagcaagctcaatcgttcgttggaaagaaaaacacaatcggaagtgtgcatggaaaagccccgatgctaatggccaataatgatgtttttactattggaccttatagggcaagaaaagatagaatgcgggtatctgtcttagaaaagtacgaagttattggctacattgctgcgggcacatatggtaaagtttacaaagcgaaaagacaaatcaactccggtaccaattccgctaatggttctagtctgaatggtaccaatgcgaaaattccgcagtttgacagcacgcaaccaaaatcaagctcttcaatggacatgcaggcaaatacaaacgcattaagaagaaacttgttaaaggatgaaggagtgacccccggaagaatacgaactacgagggaagatgtatccccgcactataattcccaaaaacaaaccctcattaaaaaaccgctgacggtattttatgccattaaaaagttcaagacagagaaggatggcgtcgaacaattgcattatacgggaatatctcagagtgcctgtagagaaatggcattatgtcgagaattgcacaacaagcatttaaccacattagtggaaatttttttggaaaggaaatgtgtccatatggtatacgaatatgcggagcatgatctgctacaaattatccacttccattcccatcccgaaaaaaggatgataccaccaagaatggttcggtctattatgtggcagcttttagacggcgtatcgtatcttcatcaaaattgggtgcttcatcgagatttgaaacccgcaaatataatggtgaccatagatggatgtgttaaaattggtgatttaggtttggccagaaaatttcataatatgctgcaaaccctctatactggggataaagtggttgtcactatatggtaccgtgcacctgagttgctattgggagcacggcactatacccctgcggttgatttatggtccgttggctgcatttttgcagaactgataggattacagcccatatttaaaggtgaagaagctaaactagactctaaaaagactgttccatttcaagtgaatcaactacagagaattttggaagttcttggcactcccgatcaaaaaatttggccttatttggagaagtatccagaatatgatcaaattacgaagtttccaaagtatagggataaccttgctacatggtatcattccgcgggaggaagggacaagcatgctttaagcttactttaccacttgttaaattatgatccaattaaaagaatagatgcatttaatgcgttggaacataagtacttcacagaaagtgatattcctgttagtgaaaatgtatttgaaggtctaacttacaaatacccggcaagaagaattcacacgaacgataatgacatcatgaatcttggatcaagaacgaaaaacaatacacaagcttcaggaatcaccgcaggtgccgctgcaaatgcgttaggtgggcttggtgttaaccgtagaattctggccgcggcagcagcagccgctgctgcggtgtcaggaaacaatgcatcagatgagccatctcgaaagaaaaacagaagatag

SEQ ID NO: 191 - DNA, 597 bp, Saccharomyces cerevisiae
atgtctaaagacacgcatgatgatgaactgccgagctacgaggacgtaatcaaggaagaggagagattgcaatctcaaccgccacgaccaccaagaccagcagctaacttggcgcaagggcaccaatcaagaccccaccaaaggccctcgacaatgccagcaacgtcctcatcccaaacatatgctcactcacactcttatacgcctacaagttcccaaccacggcctccaccgaggccacaacagaatcctagcttgccctggacataccctcccaggttttactgttccaagtgtggaaatacgggttacaagttgaagaatggacgatcttgcaagtcgtgttggaggaggtttgcacctcaaaataacgttgtttctgcaccgacatattacacaaactatacaatgcccgtgtacaccaacgcatggcagggtaataggcccttgtacgttcaaccaggggatcctcgcctgggtggcgtgctatgtggtgaatgcagagggtccggacgcaccagattcctgttggacgaagatatatgtcctctttgtcatggtgtaggcagaattatcacccagcctcaacgctattag

SEQ ID NO: 192 - DNA, 981 bp, Saccharomyces cerevisiae
atggcagaagtactgaccgtcctcgagcagccgaactcaattaaagattttctcaagcaggattcaaatattgcgtttctagctggtggagtagctggcgcggtttcccgaaccgttgtttcaccttttgagagagttaaaatactgctgcaagttcaaagttcaaccacttcttataaccgaggtatctttagctctatacggcaggtttaccatgaggagggaaccaaaggtttattcagaggaaatggtttgaactgcataagaatttttccctatagtgcagtccagtttgtagtatacgaagcttgtaagaaaaagttattccatgtaaatggcaataatggacaagaacaactaacgaacacccaaagactattcagtggtgcattgtgtggtggttgtagtgtggtggctacttacccgttggacttgatcaaaacaagactatcgattcagacagcaaatttgagcagtttaaaccgctcaaaggcaaaaagtatatcaaagcctccggggatctggcaattactaagcgaaacttacagactcgaaggcggtctcaggggattatataggggtgtatggccaacgagtcttggtgttgttccatatgtagcactaaactttgcagtttacgaacaattgagagaattcggtgtcaattcctccgatgctcagccttcctggaaaagtaacctctataaattaacaattggcgccataagtggaggggttgcgcaaacaatcacttatccctttgatctgctaagaagaagatttcaagttctcgcaatgggcggaaatgaactgggatttagatacacgagtgtctgggatgcgctcgtgacaatcggcagagcagaaggcgttagcggttactacaaaggcttagctgcaaacctttttaaagttgttccttcaactgcagtgagttggctagtttacgaagttgtatgtgattctgtaagaaattggtga

SEQ ID NO: 193 - DNA, 3303 bp, Saccharomyces cerevisiae
atgtctcagttattttatcagggcgactctgatgatgagctccaggaggaacttacgaggcagacaactcaagcatctcaaagttctaaaattaaaaatgaagatgaacccgacgactccaatcatcttaatgaggtggaaaatgaagatagcaaagttttagatgacgatgcagtgttataccctcttatacctaatgagccagatgacatagaaacgtctaagcccaatattaacgatattaggccagttgatattcaattgactttaccattgccgtttcagcaaaaagtggtagagaattcattaattactgaagatgcattaatcataatggggaaaggactaggattgcttgatattgtggccaatttattgcatgttttagctacaccaacatccattaacggacaactaaagcgagcgctcgtcctagtgttgaatgcaaaacctatagataatgtaagaatcaaggaggccttagaagagctgtcgtggttctctaatactgggaaggacgacgacgatactgctgtcgagagcgatgatgaactttttgaaaggccttttaacgtagttaccgcggactcgctgagcattgaaaagagaagaaagctatatatttctggcggaatcttgagcattacttctagaattctcattgtggatctcttatccggcattgttcacccaaatagggttacgggtatgctggtattgaatgcagactcacttcgacataattcgaatgaatcgtttatattagagatttacaggtctaaaaatacttggggttttattaaagccttttctgaagcaccagagacgtttgtcatggaattttcacccctcaggacgaaaatgaaagaattacggctaaagaacgttttgctatggccgaggttcagggtagaggtctcttcctgtttgaatgccactaataagacgtcacacaataaagtcattgaagtcaaggtctccttaacaaattccatgtctcagatacagtttggcttgatggaatgtttgaaaaaatgtattgctgagttaagcagaaaaaatcctgaactagctctggactggtggaatatggaaaatgtcctggatataaactttatcaggtcaattgactcggtgatggtgccgaactggcaccgaatttcttatgaatcaaaacaactggttaaggatataagattcctacgccaccttttaaagatgctcgtaacttcagacgcagttgacttttttggagagattcaattaagtttggatgccaataaaccgtcagtatcccgaaaatacagcgaatcaccgtggctattggtcgatgaggcacaattagtcatatcgtatgcgaagaaaagaatattttacaaaaatgaatatactttagaagaaaatccaaaatgggaacaacttattcatatattacatgatatttcacatgagagaatgaccaatcaccttcaggggcctactttagttgcctgttccgacaaccttacatgtttagaactagcaaaggtcttgaatgcctcaaacaaaaaaagaggagtacgtcaagtgcttctgaataaattgaaatggtacagaaaacagagggaggaaacgaaaaaattggtcaaagaagtgcaaagtcaggacacttttccagagaatgcaacattaaatgtaagctcgacattttccaaagaacaagtgaccacgaaaagaagaaggacaagaggtgcttcacaagttgcggccgttgaaaagctaaggaatgcaggtaccaatgtagatatggaggtggtttttgaggatcataagttatctgaagaaattaagaagggaagcggtgatgatttggatgacggtcaggaagaaaatgccgcaaacgattcaaagatttttgaaatacaagaacaggaaaatgaaatccttatcgatgatggggatgctgaatttgacaacggagaattagagtatgtgggcgaccttccgcagcacatcacaacccatttcaataaggatttatgggcagaacattgcaacgagtatgaatatgttgatcgtcaggacgaaattttaatctctacgtttaaaagtctcaatgacaattgctcattgcaggagatgatgccctcttacattataatgtttgaaccagatatatcgtttatcaggcagattgaagtttataaggccatagtgaaggatttgcaaccaaaagtatacttcatgtactacggtgaaagtattgaagagcaaagtcatttgactgctatcaagagagagaaagatgctttcacaaagttgattagagagaatgcaaatctgtcccatcactttgaaacgaatgaagatctttctcactacaaaaatttagctgaaaggaagttgaagctttcaaaattacgaaaatctaataccagaaatgcgggtgggcagcagggattccataatcttactcaggatgtcgtcattgtggatacacgtgagtttaatgcctcattaccaggcttactctaccgatatggcataagggttattccttgtatgttgacagtcggcgattatgtgataactcctgatatttgtctcgaaagaaaatcgatttctgacttaattgggtcattacagaataacagattagccaaccaatgtaaaaaaatgttaaaatactatgcatatccgacactattgattgagtttgatgaaggacagtcgttttctttagaaccttttagtgaacgtagaaattataagaataaagacatatcaactgttcatcctatatcaagcaagttatcccaggatgaaattcagctaaaactagccaaattagtattgcggtttcccactttaaagattatatggtcttcctcacccctgcaaactgtaaatataatcctagagttgaaattaggacgtgagcaacctgaccctagtaatgcagttatattgggaacgaataaagttagatcggattttaatagcactgcaaagggcctgaaggatggtgataacgagtctaaattcaagagactgttgaatgttcctggagtgtcaaaaattgattatttcaatctccgcaaaaagatcaagagcttcaataagcttcaaaagctttcatggaatgagattaatgaacttattaatgacgaagatttgacggatagaatatactacttcttgagaacagaaaaagaagaacaagaacaagagtcaacagatgaaaatcttgaatctcctggtaagaccactgatgataacgctttacatgatcatcataatgatgttcctgaagcacctgtgtaa

SEQ ID NO: 194 - DNA, 3108 bp, Saccharomyces cerevisiae
atggaagagctgaatattgattttgacgtatttaagaaaaggattgaattgttgtattccaagtacaatgagtttgaaggttctccaaattcgctgctgtttgttttaggttcgtccaacgctgaaaacccgtaccagaagacgaccatattgcataattggttgctaagttacgaatttcccgctactttgattgcattagttcccggaaaggttattataattactagttctgccaaggccaagcatttacaaaaggcaattgatctatttaaagaccctgaaagcaaaattacgctggaattgtggcaaagaaacaataaagaaccagaactcaataaaaagttatttgatgacgttattgccttaatcaatagcgctggtaaaacagtgggtatccctgaaaaggactcttaccaaggtaaatttatgactgagtggaacccagtatgggaagcggctgtgaaggagaacgaattcaatgtcattgatatttcgctgggtctttctaaagtttgggaagtgaaggatgttaacgaacaagccttcctgtccgtttcaagtaaggggtcggacaaatttatggaccttttatccaatgaaatggttcgggcagttgacgaggagttgaaaatcaccaatgccaagttatcagacaaaattgaaaataaaattgatgatgtgaaatttttgaagcaattgagtcccgatttaagcgcattatgcccaccaaactacaaattcaactttgatttattggattggacctattctccaatcattcagtccgggaaaaagtttgatcttagggtttctgcccgttctaccaatgatcagttgtacggcaacggttgtattttagcttcatgtggtattcgttacaataattattgttctaatattactaggacctttttgatcgatccatctgaagaaatggccaacaactacgattttctattaactttgcaaaaagaaattgtaactaacattctgaagcccggccgtacaccaaaagaagtttatgaatcagtaatagaatacatcgaaaaaaccaaacctgaactagtgcccaatttcaccaaaaacattggttcattgattggtctcgaatttagagattctaactttatattaaatgttaagaatgattaccgtaaaatccaacgcggtgactgctttaatatttcgtttggtttcaataatctgaaagattctcaaagtgctaacaactacgctttacaattagctgatacggttcaaattcctctcgatgaaacagagcctccacgcttcttaacaaattacaccaaagccaaatcccagatatcattttatttcaataatgaagaagaagacaataataaaaagaaatcttcacctgccaccaaagtccctagtaaaccagacagaaattccaaaattttaagaacaaagttacgtggcgaagcccgtggtggtgccgaagacgctcaaaaggagcaaattcgtaaagaaaaccaaaagaagctacacgaaaaattggaaaagaatggattactcagatttagtgctgctgatgccaatggcccagatagtgaacctcgtcaatacttcaaaaaatatgaatcttatgttcgggattcacaactaccaaccaatattcgtgatctaagaattcatgtcgactggaaaagccaaacaattattctacccatttacggtaggccagtcccatttcatataaattcatataagaatggttctaaaaacgaagaaggcgaatatacgtatttacgtttgaactttaattcaccgggatcttctggtggtatttctaaaaaagtggaggaattgccgtatgaggaatcagcagacaatcaatttgtacgttcgattacactaagatccaaagatggtgaccgcatgagtgaaacctttaaacaaattgcagatttgaaaaaagaagccacaaagagagagcaagaacgtaaggcgcttgctgatgttgttcaacaggacaaattgattgaaaataaaactggaagaacgaaaagactggatcaaatttttgtgaggccaaatccagatacaaaacgtgtacctagtactgtctttatccatgaaaatggtatcagatttcaatccccactaaggactgatagcagaatagacatattattctcaaacattaagaatctaatttttcaatcttgtaaaggtgaattaattgtcgtcattcatattcatttgaagaatccaattttaatgggtaaaaagaaaatacaagacgtccaattctatcgtgaagcttctgatatgtccgtcgatgaaactggaggtggaagacgaggtcaatccagattcagaagatatggtgatgaggatgagctggaacaagaacaagaagaaagaagaaaacgagctgcgcttgataaagaatttaagtattttgcagacgcaatcgcagaagcatcaaacggtttattgacggtggagaatacatttagagatttgggcttccaaggtgtcccaaatagatcggcagttttctgtatgccaactacagattgtttagttcaattgattgaaccaccatttttggtgattaacctagaggaagtcgaaatctgtattttagaaagagttcaatttggtttgaaaaacttcgacatggtttttgtttataaagatttcaataaacccgtcactcatatcaatacagttccgatcgaatctttagatttcttgaagcagtggttaacagatatggatattccttacactgtctcaacaatcaatttgaattgggcaactattatgaagtcattacaagatgatccatatcagtttttcttagatggtggttggaattttctggctactggttcagatgatgaagcatctgatgaaagtgaagaagaagttagtgaatatgaggcttcagaagacgacgtaagtgatgaaagcgcattttctgaagatgaagaaggatcagaggtggatgacgatattagtggtgatgaaagtgaggactatactggcgacgagagtgaggaaggtgaagactgggatgaattagagaaaaaggctgctagggctgataggggtgcaaactttagagattag

SEQ ID NO: 195 - DNA, 2853 bp, Saccharomyces cerevisiae
atgagtgacaatccatttaatgcgagtcttcttgacgaggactcaaaccgtgagagagaaatactagatgccacagcagaggccctttcgaaaccaagcccttctttagagtattgtactttatccgtggacgaagctctagaaaaactggacactgacaaaaacggtggtttacgatcatctaacgaggccaacaataggagatcactttatggccccaatgaaataaccgtagaagatgatgaaagtcttttcaagaagttcttgtcaaatttcattgaggatcgaatgattctacttttaataggatccgcagtggtctctctttttatgggtaacattgatgatgctgttagtatcacactggccattttcatagttgtcactgtcggttttgtccaagaatataggtctgaaaaatctctagaagcgttgaataaattggttcctgctgaatgtcacttaatgagatgtggtcaagagagtcatgtactggcttccaccttggttcctggtgatttagtgcacttcagaataggtgacagaatccccgcagacattagaattattgaagcaatcgatttatccatcgatgaaagtaatttaactggtgaaaatgaaccggtacataaaacctcacaaacgatcgaaaaatcttcctttaacgatcagcctaattcaattgtaccgatttctgagagatcttgtatagcttatatgggtacattagtcaaggaaggtcatggtaagggtatcgtcgtaggaacaggtacaaacacatcctttggtgccgtttttgaaatgatgaataatattgaaaaaccgaagactccattgcagttaacaatggacaaattgggaaaggacttgtcactggttagcttcatagttattggtatgatttgtttagttggtatcatacaaggtagatcttggttagaaatgttccaaatatcggtatccttagcggttgctgctattccagaagggttaccaattattgtcactgttactttggcattgggtgttctgagaatggccaagcgtaaagccatcgtgagaaggttaccaagtgtcgaaactttaggctctgtcaacgttatctgctccgacaaaacaggtacactaacctcaaaccacatgaccgtatctaaactttggtgcttggacagtatgtccaataagctaaacgtcctctcattagacaaaaataagaagactaaaaattctaatggaaatttgaaaaactatttgactgaagacgttagggaaactctaactatcggtaatctctgtaataatgcatctttctctcaagaacatgccatatttctgggaaatcctactgatgtagctcttttagagcaattggcaaactttgaaatgcctgatatcagaaacaccgttcaaaaagttcaggaacttccatttaactcgaaaagaaaattaatggcaaccaagattctcaaccctgtcgacaataagtgtacagtttatgttaaaggtgcatttgaaagaattcttgagtactccacaagttatttgaaatcaaagggtaaaaaaactgaaaagttgactgaagcccaaaaagctacgataaatgagtgcgcaaattctatggcatctgaaggtttgcgtgtctttggatttgctaaactaactttgtctgattcatcaactcctctaaccgaagacctaatcaaagatttaacctttactggtttaatcggtatgaatgacccaccaagaccgaacgttaaatttgccatcgaacaattactacaaggtggtgtccatattattatgatcactggtgattctgagaataccgcagtaaacattgcaaaacaaattggtattccagttattgatccaaagctttccgttttatccggtgataaattagatgaaatgtcagatgatcaactggccaatgtcatcgaccacgttaatatttttgctcgtgctacgcctgagcataagttaaacattgttcgtgcattaagaaagaggggtgatgtggtagcaatgactggtgatggtgttaacgacgctcctgcgttgaaactttcagatattggtgtttctatgggtagaattggtacagatgtagccaaagaagcctcagatatggtcttaactgatgatgacttcagtactattttaactgccattgaagagggtaaaggtatctttaataatattcagaatttcctgacttttcaattgtctacttctgttgccgcactatcattagttgcactatctacagcgtttaaactacccaatccactgaacgcaatgcaaattctttggataaatattttaatggatgggccaccagctcaatccttaggtgtggaacctgttgatcatgaagttatgaaaaaacctccaagaaaacgtaccgataaaattttgacccatgatgtaatgaaacgtttactaaccaccgcggcctgtatcatcgttgggacagtttacatttttgttaaagagatggccgaagatggtaaagtaactgctagagatactactatgacatttacttgttttgttttttttgatatgtttaatgctttggcctgcagacataacacaaagtcaatcttcgaaatcggctttttcacgaacaaaatgttcaactacgccgttggactgtctctgttaggtcaaatgtgcgctatatatataccatttttccaaagtatctttaaaactgagaaacttggtatctctgatatactattgttattgctcatcagcagtagcgttttcatcgttgatgaattgagaaaattgtggacgaggaaaaagaatgaagaagactcaacgtatttctcaaatgtttga

SEQ ID NO: 196 - DNA, 3276 bp, Saccharomyces cerevisiae
atggataaaagtaagcagatgaacatcaacaacttgtccaacatccccgaggtgattgaccctggcatcactatcccaatatacgaggaagaatacgagaacaatggagagagtaatagccaactgcagcaacaaccccaaaagcttggatcatataggtcgcgagcaggaaaattttctaatacattgagtaaccttttgccctccatcagtgccaagttacaccattcgaagaaaaatagtcacggaaagaacggtgctgagttttcctctagcaacaacagttcccaatctacggtggcgtccaagacaccaagggccagcccttccaggagtaagatgatggaaagttctatagacggtgtaactatggatagacctggcagtttaacccctcctcaagacatggaaaaattggtgcattttcctgactcgagtaataacttcttaattcctgccccccgaggatctagcgactcgtttaacttgccacatcagatctcgaggacgagaaacaacacaatgtcttctcagataacttccatttcatcaatcgcccccaagcctcgtacttcgagcggaatatggtcttcaaatgctagtgcgaacgatcccatgcaacagcaccttttgcaacaattgcaacctacgacaagcaataatacaactaattcaaacacgctcaacgattattcgacaaaaactgcatattttgacaacatggtatctactagtggaagccaaatggcagataataagatgaatacgaataacttggctatcccaaactctgtttggtcaaataccagacagagatctcaatccaacgcgtctagcatatataccgacgctccactgtacgaacagcccgctcgtgccagtatttcatcgcactatactattccaacacaggaatctccattgattgctgatgaaatagatccgcaatccatcaattgggtaacaatggaccccactgtaccatcaataaaccaaatatcgaaccttttacccacaaataccatttctatttccaacgtttttcccctacagcaccagcagccacaattaaataacgcgataaacttaacaagtacttccttggcaaccctatgctccaaatatggtgaagtcatatctgctaggactttaaggaatttaaacatggctttagttgaattttcttccgtggaaagtgccgtaaaagccttagatagtttacagggcaaggaggtatctatgattggagcaccaagtaaaatttcatttgccaaaatcttacctatgcatcaacaacccccacaatttcttctcaattctcaaggcttgccattgggtttagaaaacaacaatttgcaaccacagcctttattacaggagcagttattcaatggagctgtgactttccaacaacaaggaaatgtttctatacctgtatttaaccagcaatcacaacaatcgcagcaccaaaaccatagttcgggttctgctggttttagcaatgttctccatggttataataataacaatagtatgcacggaaacaacaataactcagcaaatgaaaaagaacaatgtcctttccctctaccaccacctaacgttaacgaaaaggaagatttgttaagagagatcatcgaactttttgaagcaaattccgatgaataccaaatcaattcgttgataaaaaaatcgctgaatcacaaaggcacttccgatacgcaaaactttggacctttaccagaaccattgtctggcagggagttcgatccaccaaaattacgcgaattgcgaaaatcaatcgattcaaacgcattttccgacttagagatcgaacagttggctattgcaatgcttgacgaattgcccgaattgagttcagattacttgggtaacactatcgttcaaaaattatttgaacattcatctgatattattaaagacatcatgctgaggaaaacaagcaaatacctaacctctatgggtgttcacaaaaacggaacatgggcttgtcagaagatgatcactatggcgcatactccgagacaaatcatgcaagtgacgcaaggggtcaaggactactgtactccattaatcaatgaccaattcggaaattatgtcatacagtgcgttttgaaatttggattcccctggaaccagtttatttttgaaagtataatagctaatttttgggttattgttcagaatagatatggtgcaagggcagtcagagcttgtttagaggcacatgacattgtaactcctgaacaatcaatagttttgagtgcaatgatcgttacatatgctgaatatctaagcactaatagcaatggtgcgttgttagtaacgtggtttttagatactagtgttttacccaacagacattctatcttggcaccaagattgacgaaaagaattgtagagttatgtggccacagattggcttctttgactattttgaaggtcttgaattacagaggggatgataacgctagaaaaatcatcctagattccctatttggaaacgtgaacgcacacgattcttcgccaccaaaggaattaacaaagcttttatgtgaaacaaattatggcccaacctttgtccataaagttttagcaatgccattattagaagatgacttaagagcccacatcattaaacaagtcagaaaagtattgacggattctactcaaatccaaccaagccgccgtttattggaagaagtcgggttggcatcaccctctagtactcataacaagacaaaacaacaacagcagcagcatcataacagcagcatttcgcacatgttcgccactcctgatacttctggacaacacatgagaggtctttctgtttctagcgttaaaagtggtggatctaaacataccacaatgaacaccacgactacaaatggttcttctgcctctacattatccccgggccaaccattgaatgccaattctaattcttcaatgggctattttagttatcctggcgtcttccctgtcagcggcttttcaggcaacgccagtaatggatatgctatgaacaacgatgacttaagttcccagtttgatatgctaaactttaataacggaacccgtttatcgttgccacaactgagcctaactaaccataacaacactactatggaattagtaaacaatgttggctcctcacaacctcatacgaacaacaacaacaataataacaacacgaactataacgacgataacaccgtttttgaaactctgactttacactctgcaaactga

SEQ ID NO: 197 - DNA, 2922 bp, Saccharomyces cerevisiae
atgacttcactttcttcacagccagcgtacacgttggttttcgatccttctccgagtatggagacttactcgagtaccgattttcagaaagctcttgaaaagggatctgatgaacaaaaaattgacacgatgaaatcaattttagttacaatgctggaaggaaatccaatgcctgaattgttgatgcacataataagatttgtcatgccttctaaaaataaggaattaaaaaagcttttgtacttctactgggaaattgttcccaaactagctgaagatggaaaattgagacatgaaatgattcttgtctgtaatgccattcaacacgatttgcaacatcctaatgaatatattagaggtaacacattaaggtttttaacgaaattgagagaggccgaactcttagaacagatggttccctctgtcttagcgtgcttggaataccgtcatgcatatgttcgtaagtatgcaatcctagcagttttctccattttcaaggtcagcgaacatttacttcccgatgctaaagaaatcatcaattcgttcatagtagctgaaactgatccaatatgtaaaagaaatgcatttattgggttagctgaattagatcgtgaaaatgccttacactatttagagaacaatattgctgatatagaaaacctagaccctttattacaagctgtctttgttcaatttatcagacaagatgcaaacaggacccctgctttgaaagcccaatatatcgaattattgatggaactgctttcgaccacgacttccgatgaagtcatcttcgagaccgcattagccctaactgtgttgtctgccaatccaaatgtcttggttcctgcggttaacaaattgattgacttggccgtcaaggtttctgataataacattaagttaattgttctagaccgtattcaagacatcaatgctaataacgtaggtgctttggaagagttaaccctggatattttgagagtcttgaatgcagaagatttagacgttcgttcaaaggcgcttgatatttcaatggacttggccacatccagaaatgctgaagatgttgttcagcttttgaagaaagagctgcaaacaaccgtaaataacccagatcaagacaaggcaatgcagtacagacaattgttaataaaaactattcgtaccgtggctgtaaactttgtagaaatggcagcaagtgttgtttcgctattattagatttcatcggtgatttaaactcggttgccgccagtggtatcattgcctttatcaaagaagtgatcgaaaaatacccacaacttagagccaatatccttgaaaacatggttcaaacgctagacaaagtgagatctgctaaagcttaccgcggtgcattatggattatgggtgagtatgctgaaggagaaagtgagatacaacattgttggaagcacattcgtaacagcgtaggtgaagttcctatccttcaatcagaaatcaaaaagttaacacaaaaccaagaacacaccgaagaaaatgaggttgacgctaccgccaagccaactggtccagttattctaccagacggtacgtatgccactgaaagcgctttcgatgtgaagacttctcaaaagtcagttaccgatgaagaacgtgattctagacctccaattcgccggtttgttttaagtggtgatttctacacagctgccattctggccaacaccatcattaaacttgttttaaaattcgaaaacgtttccaagaacaaaactgtcatcaatgctctaaaggcggaagctttactaattttagttagtattgtaagagtgggtcaaagctctttggtggagaaaaaaattgatgaagattctttagagagagttatgacatctatttctattttattggatgaagttaatcctgaggaaaagaaggaagaagttaaacttctggaggttgcattcctggacaccaccaaatcctcattcaagagacaaattgaaattgcaaagaagaacaagcataagagagcattaaaagacagttgcaaaaacatcgaaccaattgatacgccgatttctttcaggcaatttgctggtgtggattctactaatgtgcaaaaagatagtattgaagaagatttacaactggcaatgaaaggagatgcaatccacgctactagcagctctagtatttcgaagctgaagaagatagtacctttatgtggcttttctgatccagtttacgccgaggcttgtattacaaacaatcaatttgacgtcgtattagatgttcttcttgttaatcaaacgaaagaaacattgaaaaacctacatgtgcaatttgcaactcttggtgatttgaagattattgacacaccacagaagaccaacgtgattcctcatggcttccacaaattcactgttactgtcaaagtttcctctgctgacacaggtgtcattttcggtaatattatttatgatggtgcgcatggtgaagatgctcgttatgttattttaaacgacgttcatgttgacattatggattatatcaaaccagccactgctgacgatgaacatttccgtaccatgtggaatgcatttgagtgggagaacaaaatatcggtcaaatcacaactaccaacattgcatgcttatttgagagaactggtcaagggaactaatatgggtattctaacaccatcagagtcgttgggagaagatgattgtaggttcttaagttgtaatctgtatgcgaagtcgtcctttggtgaagatgccctagccaacttgtgtatcgaaaaggattccaaaaccaatgatgtcataggttatgttcgtatccgatcaaagggacaaggtttggctctgtccctaggtgacagagtggcattgattgctaagaagaccaataaacttgctctcactcatgtttga

SEQ ID NO: 198 - DNA, 324 bp, Saccharomyces cerevisiae
atgtcagctcaagattattacggaaactctgcctccaaacaaagctattctcgtcctagcgctccaccaccaggatatgaaacggcgtctagaggttacgctccatcgcaaagccaacagaactattatccacctcaacagcagcagcagcagtatcagcaacaacctcaatactatcagcaacagcagccccaatattaccaacaacacccacagcagcccatttatgtccaacaacaaccggccagttctggaaatgaagactgtctagcgggctgtctagcgggtttatgtttatgctgtactttggatatgctgttttag

SEQ ID NO: 199 - DNA, 987 bp, Saccharomyces cerevisiae
atgcctgcccctcaagatccaaggaatcttccaattagacaacaaatggaagctcttatccgtcgcaaacaagctgaaatcacgcaaggtttggaatccatcgatactgttaagttccacgctgatacttggacccgtggtaacgatggtggtggtggtacctctatggttatccaagacggtacaactttcgaaaaaggtggtgttaatgtctccgttgtttatggtcaattgagcccagcggccgtttcagccatgaaagctgatcataagaatctgcgtctaccagaagatccaaagactggtttgccagttaccgacggtgtcaagttcttcgcttgtggtttaagtatggtcattcatcccgttaacccacacgctccaaccacgcacttaaactaccgttacttcgaaacttggaaccaagatgggaccccacaaacttggtggtttggtggtggtgctgatttgacaccttcttacttatacgaagaagacggtcaattattccaccaactgcacaaggatgccttggacaagcacgacactgctttgtacccacgtttcaagaaatggtgtgatgagtacttctacattacccaccgtaaggaaacacgtggtattggtggtatattctttgacgattatgatgaacgtgacccacaagaaatattgaagatggttgaagactgtttcgatgctttcttgccatcctacttgactatcgtcaagagaagaaaagatatgccatatacaaaggaagaacaacaatggcaggccattagacgtggtagatacgttgaattcaacttaatctacgatagaggtacccaattcggtttgagaaccccaggctctagagttgagtcaattttgatgagtttgcctgaacatgcttcatggttatacaaccaccaccctgctcctggttccagagaagctaaattactagaagttaccaccaaaccaagagagtgggttaaataa

SEQ ID NO: 200 - DNA, 2178 bp, Saccharomyces cerevisiae
atgcctcaatctactccaagtcaagaagtacagcgtgtaccatgggataataaacctgctttgaagcagataacactccgagcaaccatagcaggtatcgctatagggtctctggtgctaacatcaaattttcaatttggcctgcaaaccggttgggtttccatgatgtccctgccatcggcattgttagcttgtgctttctttaaaaatatctggccattaatatttccgaacgacaggcctttcagtgacgttgaaaatgtatacgtacaaagtatggcagtagctgtcggaacaggcccattagcctttgggtttgtcggcgtcatacctgccatcgagaagttccttactaacgacgaaagtggtggattaagggaacaaggacagtccttcacttttagagaattgttaatatggtccacagccctagcattcttcggtattttttttgcagttcctctaagaaagcaagtaattgttagagagaaacttcccttccccagtggtagcgccacggccactttaatttcagtgctaaatggaactgagattttacaagaggtttctaagtcagagttattggaaatgaggcagaggagattgaatgaatgccctgaagtgctacaacccaacagagatccagaggaggcggattatttaatgaactcttctcatagcgaacttggtgattatacggcaactagccaagatggaagttctatcctttctactggctctgagaactacagagcgaatattattattttattgaaaacttttgttgtttcttcgctttacaccatggtgtcatattttgtaccggtaatacggtctattccagtcttcggaaaatacctctcgaacaattatctctggaattttcagccgtcgcctgcgtatataggccaagggataataatgggtcttccaacagtatcgtatatgcttatcgggtgcttcttaggctggggtgtgttagcaccattggcgagatacaaaagatgggtaccaccagatgctgatgtccacgactgggaggagggagtgcaaggatggattctttggtcgtcgctttcaataatggttgctgacagtgtagtcgcttttattgttgtgacagtgaagtccattgtgaaatttattcttatagatgacaaagctgctttactgaacaacataatcgatgatacatttcaatctatgttactggaggaggaacgcgccattaatagcagcagaagaaatacatatgttgatggaaggcaggacaccgtaagattagtgagtagagataacgaaatagaagtagattcgaagcatttggttcgctataccaccgttatcagtggatgtctagtctcctcgataatatgcattgtttccataatatatttgtttgggatacaagtaattcccctatatgctattatcactgctttgatacttgcgttgtttctatctattctcggtattcgagcacttggagagaccgatctgaatcctgtgagcggcattggtaagatctctcaattgatttttgcctttatcataccaagggatagacctggatcagtgttaatgaacgtggtatcgggaggtattgcagaagcctctgcccaacaggcgggcgatttaatgcaggatttgaaaacggggcacctcctcggcgcctccccaagagctcagttctgtgcccaattgataggggcctgttggtcaattattttgtctagcttcatgtatttgtgctacaataaagtttattcaattccgagtgagcaattcaggataccgacagcagtagtgtggatagattgtgcaagactagtaactggtaaagggctccctgataaggccttggagtgctccatgattctcggagtcatatttgccgttttatcattaatcagaaacacttatagagattacggatacgggtggatattatatattccgtctggtgtagcagtcggtgttggtatatttaattctcccagttttacaattgcaagattcatcggcgggtgggcttcgcatttttggttgaagaatcataggggtgacttaaatgcgaaaacaaaaatgattgtattcagttcggggttggtcttaggtgaaggtatctttagcgtaataaacatgctcttcatctgcttaaatgtccctcactattag

SEQ ID NO: 201 - DNA, 1533 bp, Saccharomyces cerevisiae
atgccaacttctggaactactattgaattgattgacgaccaatttccaaaggatgactctgccagcagtggcattgtcgacgaagtcgacttaacggaagctaatattttggctactggtttgaataagaaagcaccaagaattgtcaacggttttggttctttaatgggctccaaggaaatggtttccgtggaattcgacaagaagggaaacgaaaagaagtccaatttggatcgtctgctagaaaaggacaaccaagaaaaagaagaagctaaaactaaaattcacatctccgaacaaccatggactttgaataactggcaccaacatttgaactggttgaacatggttcttgtttgtggtatgccaatgattggttggtactttgctctctctggtaaagtgcctttgcatttaaacgttttccttttctccgttttctactacgctgtcggtggtgtttctattactgccggttaccatagattatggtctcacagatcttactccgctcactggccattgagattattctacgctatcttcggttgtgcttccgttgaagggtccgctaaatggtggggccactctcacagaattcaccatcgttacactgataccttgagagatccttatgacgctcgtagaggtctatggtactcccacatgggatggatgcttttgaagccaaatccaaaatacaaggctagagctgatattaccgatatgactgatgattggaccattagattccaacacagacactacatcttgttgatgttgttaaccgctttcgtcattccaactcttatctgtggttactttttcaacgactatatgggtggtttgatctatgccggttttattcgtgtctttgtcattcaacaagctaccttttgcattaactccttggctcattacatcggtacccaaccattcgatgacagaagaacccctcgtgacaactggattactgccattgttactttcggtgaaggttaccataacttccaccacgaattcccaactgattacagaaacgctattaagtggtaccaatacgacccaactaaggttatcatctatttgacttctttagttggtctagcatacgacttgaagaaattctctcaaaatgctattgaagaagccttgattcaacaagaacaaaagaagatcaataaaaagaaggctaagattaactggggtccagttttgactgatttgccaatgtgggacaaacaaaccttcttggctaagtctaaggaaaacaagggtttggttatcatttctggtattgttcacgacgtatctggttatatctctgaacatccaggtggtgaaactttaattaaaactgcattaggtaaggacgctaccaaggctttcagtggtggtgtctaccgtcactcaaatgccgctcaaaatgtcttggctgatatgagagtggctgttatcaaggaaagtaagaactctgctattagaatggctagtaagagaggtgaaatctacgaaactggtaagttcttttaa

SEQ ID NO: 202 - DNA, 1587 bp, Saccharomyces cerevisiae
atgtttggaatacgttcaggcaataataacggtggatttactaacctcacgtcgcaagcaccacagacaacccagatgtttcaatcgcaatcacagttgcagccacaaccgcaaccgcaaccacaacaacagcagcaacacttgcaattcaatggatcatccgatgcaagttctttacgatttggaaactcactttccaatactgtaaacgccaataactatagtagtaatatcggtaacaatagcatcaacaacaacaacattaaaaacggcacaaataacataagccaacatggccaagggaataatcctagctgggtgaataatcctaaaaagagattcactcctcatacggtgataagaaggaagacaacaaagcaaaattcttcttctgacatcaaccagaatgatgattcatcttctatgaacgctactatgagaaatttcagtaagcaaaatcaagattccaagcataatgaaagaaataagtctgcggcaaataatgacatcaattctctgttgtcaaattttaacgatattccaccctccgttactttacaggattggcaacgcgaggatgaattcggttctattccatcattaacaactcagtttgttaccgacaaatacacggcgaagaaaacaaataggtcagcttatgattccaaaaatactccaaatgtttttgataaagactcttatgttagaatagcaaacattgaacagaaccatttagataataattacaacaccgccgaaacaaacaataaagtccatgaaacatcttccaagtcttctagtttgagcgcaattatcgtatttggctatcctgaatcaatttccaatgaattgattgaacacttctcccatttcggtcatattatggaagactttcaagtattgcgattgggtcgcgggattaaccccaacaccttcagaatattccataatcatgatacaggctgtgatgaaaacgattctactgttaataaatctattactttaaaaggcagaaataatgagtcgaataacaaaaaatatccaatatttactggtgaaagttgggtcaaactcacttataattctccatcttctgctttgagagcactgcaggaaaatggaaccatatttcgcggttctttgattggttgcatcccatattcaaaaaatgcggtggagcaattagctggctgcaaaattgataatgtcgacgacattggagaattcaacgtttctatgtatcaaaattcctccacatcgtcgacatctaatacaccatccccaccaaacgtaataataactgatggcactcttctgagggaagacgataatactcctgccggtcatgctggtaatccaacaaatatttcaagtccaatagtagcaaattctccgaataagcggctggatgtaatagatggcaaattgccattcatgcaaaatgcaggaccgaattcgaatattcctaatctgttgcgaaacctagaatcgaaaatgcgtcagcaagaagcgaaatacagaaataatgaacctgctggttttacgcacaaactgagtaattggttatttggttggaatgacctataa

SEQ ID NO: 203 - DNA, 2787 bp, Saccharomyces cerevisiae
atgtttacgtcgcagcgacagcttcgacaaaatgggagtccgatgtcatcatcacgttcatcacaacattcctctggtacagcgtcgccgatatcagactctccagcatcgaatcgcagctatggaagagatctacgaggcttaatgggaattgatatacctgctaacgaaccagcttttaacagggccaatagcagtgatacaatctatttcaggcctaagaagatttacaaaatggaacatgagcacccatcacgatctactttagtacaactgcagacaagatcgcagccggacgatgtcgcaagtagtcaagtaaaccctgaaggcggaaccgacgatctagagctgggcgatccgtgtggcaatcaatctttatacactataggggcggagtacgttccagatttagactttacaaagctagtgaatgagtggcaaaagtccaccgaggatttgtatgagttcagaagcagtgccactccgcaggtacaaatcaaagacagtggaaagggaaactacgaactttggagctcaccggatgcaatattgactcaaaacaaacttcgaagagatagtttttcgcaagagaacagtgattcgttaagtccagaagattctattttatcaagaaatttgcattctaaggtcaaacccatccctctgcccagaaacagccagcaaatatttacacccctgtccaacttagaagcggaaaggagatcctcatatacaactagtagcaacaacaatagcataacacagaataataaattctcttttgcgaagttaaagtattcacttccaactcaaagttctgcagttcctgcgtcgttcgattcaaatgcttcgtcactaaattttcttccgactactacattatcgaccttatcagagctacaaataagccccaacgatatgatggatttgattcagaagcttcccagaaattttttgaacttgccgtatactcaaaggaaaaaggtgattatcgagcatgcaccatctcatgactacaaggccatgatgtccctagttaagaagtttatgttaacatcttctagaagtaacttttctctcgctgggtttgccaataatgcttcagtttcgcaggccacggctaatgatgataacatcaatagtaggaacacgcccaataatagcaatgacacctacgtaaatacgcgtccacttcaaagatctaggcacggttccattgcatcccaatttttaagttctttttcaccttcgatgacgtcaatagctaaaatgaattcgaacccattgagtggaagcgcaggtggcagtgcgagaccagacgataagggtatggaaatactaggtcatcggttgggtaaaatcataggtttcggcgcatgggggatcatacgggaatgctttgatattgaaactggtgttggtagagtgataaaaattgtgaagttcaaaggacaccaaaatatcaagaaacatgtgctgagagaagtagccatatggaggactttgaagcataacagaatactcccccttttagattggaagcttgatgacaactatgcaatgtattgtttaacggaaagaattaacgatggtaccttatacgacttggtaatatcttgggacgaattcaaacgttcgaagataccatttgcagagagatgcagattgaccatttttttaagcttacaactattatctgcattaaagtacatgcattccaaaacgattgttcatggtgacatcaaattagaaaactgtctgttacaaaaagaaggtaaaaaatcggattggaaggttttcctatgcgattttggaatgagttgccacttcgatgagaagcatgtttatcgtaacgatacttttgatgaaaacttgagtagtggcaacagccatagaaagagaaaaagtattgaacaaactaatttgataaagtatcccacaaccaattttttacctgacgaccgaactaatgattttgacgctagtgaaaacttaaaataccaatttgaaaatcgaaagcatcaaccgtttacaccaaaaggaatggttagctccagttcacattcattaaagcatctcaatcaaccatcctcttcttcttcttctaatctatttcacaagccagcctctcaacctcaaccacagcatcggagtccctttcatgggaggcacaagacaaccgatttttcaaacctggaacccgaaccttctaaatatatcggatctctgccttacgcttcgccagaacttctaagatactcagatgcaagacgttcaaaatcagttgaaatgcatatttatgattcaccagactcctctcaatcggaaattagcgcagcatcatcatcttcctctaatttatcttctctatcatcctctacaaaggcgtccgcagtcacgaattccggtgtaactacaagttcaccgtctggttcatcgactgattttccatgtattgtttctcctttaggaccagcatccgatatttgggccttgggagtaatgctatatacaatgttagtaggaaaattaccctttaatcatgagttcgaacctaggttacgctctctgattaaagtaggcgaatttgaccgattttctttagctcaggtctgtaaatttgacaggaaaaaaaatgaaggaacgattggtcaaggcttgtatgacacagtcattggatgtttgacgattgacttggataagaggtggaaattgaaaaggattgaagaagtccttcaaaacgaaatgaacctaagcgaggccattcacgataataatggctcatga

SEQ ID NO: 204 - DNA, 2409 bp, Saccharomyces cerevisiae
atgtcagatgaaaaccataacagtgatgttcaagatattccttcacctgaactatccgtcgatagtaactctaacgagaatgaattgatgaataactcaagcgcagacgatggaatcgaatttgacgccccagaggaagaaagagaagccgaaagggaggaggaaaatgaagaacaacacgaactggaagatgtgaacgatgaagaggaggaagataaggaggaaaaaggagaggaaaacggggaagtaataaacacagaagaagaagaagaagaagaacatcaacaaaaaggcggaaatgatgatgacgatgatgataatgaagaggaagaagaggaagaagaggatgatgacgatgatgatgatgacgacgatgatgatgaagaagaagaagaagaagaagaagaagaaggcaacgacaacagttcggtaggctcagatagtgccgctgaagacggtgaggatgaggaagacaaaaaggataaaaccaaagataaagaggtcgaacttcgccgtgaaacattggaaaaagaacaaaaggacgtagatgaagctataaaaaaaataactcgtgaagaaaatgataatactcactttccaactaatatggaaaatgttaattacgatcttttacaaaagcaagtcaagtacattatggacagtaacatgctaaatttgcctcagtttcaacatttacctcaagaagaaaagatgtctgcgattttagcaatgttaaattcaaattctgacacagctctttccgtacctcctcatgatagtactatctcaacaacagctagcgcctcagccacaagcggcgcaagaagcaatgatcaaagaaaacctccattgtcagatgcccaaagacgtatgagatttcctagggcggatttatctaagccgattaccgaagaagaacacgaccgttatgcagcctatttgcacggtgaaaataaaatcaccgagatgcacaatattcctccgaagtcaagattattcattggtaatttgccgctaaagaacgtttctaaggaggatttatttaggattttctctccatacggtcatatcatgcaaatcaatatcaaaaatgcctttggattcattcagtttgacaaccctcaaagcgttagagatgcaattgaatgcgagtctcaagaaatgaactttggcaaaaagttgatcctggaagtttctagctcgaatgctcgtcctcaatttgatcatggtgatcacggtacaaacagtagttctacttttatttcttccgcaaaacgaccatttcaaactgaatctggtgacatgtacaatgacgacaatggtgctggctacaagaaatccagaagacacaccgtttcttgcaacattttcgttaaaagaaccgcagatcgtacgtatgccattgaggttttcaacaggtttagggacgggactggtttggaaactgatatgattttcttgaaaccaagaatggaactgggaaagcttatcaatgatgccgcatataatggggtgtggggcgttgttttagttaataaaacacacaatgtagatgttcaaactttctacaaaggctcacaaggtgaaacgaaatttgatgaatatattagcatatccgctgatgacgcagttgccatttttaataacatcaaaaacaacagaaataattctcgtcctactgattaccgtgctatgagccatcagcaaaacatatatggcgctcctcctcttcctgttccaaacggcccagctgtcggacctcctcctcaaacaaactattaccagggttacagtatgcctcctccacaacaacaacagcaacagccatatggtaattatgggatgccaccaccatcccatgaccaaggatatggttctcaacctccaattccaatgaatcagagctacggtcgctaccagacttctattccaccaccacctccacaacaacaaattcctcaagggtatggtcgttatcaggctggtccgcctcctcaaccaccttctcaaactccaatggaccagcaacaactattatctgccattcaaaaccttccacctaacgttgtatcgaatttgctttcaatggcccaacaacagcaacaacaacctcatgctcagcagcaattggttggtttaatacaatcaatgcaaggccaggctcctcaacaacagcaacaacagttgggtggatattcctctatgaactcatcctctccccctcctatgagtaccaattacaatggtcaaaatatatctgcaaaaccctctgccccaccaatgtcacaccaacctccgccacctcaacaacaacaacaacaacaacaacagcaacagcaacagcaacagcaacctgctggcaataatgttcaaagtctattagatagtttagcaaaactacaaaaatag

SEQ ID NO: 205 - DNA, 1470 bp, Saccharomyces cerevisiae
atgggtaatgttccagggaaaatagaccaggaagatagttttaatgatgtcaggccagattcctcatataatactacatcatcgaattctgtcatcaaacaatatgatgaagaagcctcttcaagggtgagaacgagacgcacgacgtctttggtcaataatattttaaatgggaataatgctcgtacaaaaactggttctcatctatccagcactagtagaagaaagacgtcacgggaaaaagagcttgctaaagaggcacatgctaaacaattggttgtgaggtgtagcgaaactgtagatggggggtttttggccccatttggctgttattcttttgaaaagttggactatgatgctactgtcgttaaaaatttaataatcaaaagaaagttagcgccgttttacactcctttgcaggattttgatgaaagttggactagagatgagttgataaaaattgttgacggattgcccttgcatgacacgttcgatgaaaatttggaagaattcgaagacgtaccgataggcaatttaaggaagtcaacatttaatgaattaatagacaaatctttatccaagaaggaacagagaagaatgcacgcaaagatttttagagcaagattgtataagaaaagaattttatggcaagaaaatgaaaatgagacgtttttggagaggaaattggaaatgaaaagaattggcagcaagtccagcaatgttgaagataataccagtagccagccaaggaaaaattaccatttaccaagtgacgatttgaagtatactctttacaaaaatgggtcggaatgccctatttgttttttatactttccagggcctttcaactattccaaatgttgtcaacagcctatttgtaccgagtgttttgtacagattaagagagctgatcctcacttccctcatgacgaagtagacccaactgaaccacaaactaatgacagtgaaaaggacccaaatcttcttacctctgagccagcaaattgcccctactgtgcaactgctagttttagcatcacttatcaaccacccacaaatcgtgaaactggtatagggggtatgccagccgactcatacgtgtataaggacgccgccatatcaagagctgatggcggtcagccaaacatatcagccattacttcggataccattcgtcctgattgggagattaaattgaacaaagaaagggcaaggttgatgaggagatccgcgaatgccaccgctatacatataagtaataggttgatcgatccaagccatagcagaaggagaaatacaagtcacagtataacccctattcatgatgaaagtacgtcagcttcaagatctcctgaaccgacaataaacgaacttgaagatcaaatggttagagaggctattaggttaagccttgaagatcaggacaaccgaaaaaaatcaaagaatagaaacacctctttgagaccatag

SEQ ID NO: 206 - DNA, 2931 bp, Saccharomyces cerevisiae
atgaaagtgaagaaatcaactagatcaaaagtttcgacagcatgtgtcaattgcagaaaaaggaaaatcaaatgcacaggtaaatatccatgtaccaactgcatttcttacgattgtacgtgtgtattcctaaaaaaacatttaccgcagaaggaggatagttcccagtctttgcctactacagctgttgctccaccctcttcccacgccaatgtagaggcttcagcagatgtacagcatctggacactgcgattaagctagataatcaatattacttcaaactgatgaacgacctgatacagactccagtctctccgagtgcgacgcatgctcctgatacttccaataatcctactaatgataataatattctctttaaagatgattccaaatatcaaaatcaactggttacgtatcaaaatattctgacaaatttgtacgctctgccgccttgtgatgacactcagctcttgattgataaaacgaagtcgcagttgaataacctgattaacagttggaatcccgaaataaactaccccaagctttccagtttctctcctcgcccacaaagatcgatagaaacgtatcttttaaccaacaagtatagaaataaaatacacatgacgaggttctccttttggacagaccaaatggttaaatcacaaagtccagattcatttctagccaccactccactagtagatgaagtatttggtcttttctctccaatacaggctttttcactaagaggtataggatatttaattaaaaaaaatatcgaaaacacgggttcatcgatgttaatagatacaaaggaaactatttatctaatattaagattgtttgatttgtgttatgaacatttgatccaaggttgcatctctatttctaatccattagagaactatcttcaaaaaataaagcaaactcctactacgacggcatctgctagtttgcctacttccccagcacctttatctaacgatttagtcatttctgttattcatcaactacctcagccatttatacaatcgattaccgggtttacgactactcaattgatagaaaatttacatgattcattttcgatgtttcgaatagttactcaaatgtatgctcaacataggaagcgctttgcggaatttttaaaccaagctttctccttgccccatcaagaaaagagtgttttattctcgtcattctgctcatcagaatatcttctatctactctttgttacgcatactacaatgttaccctatatcacatgttggacataaacactttagattacctagagattttagtgtcattgctagaaatccaaaatgaaattgatgagcgttttggatttgaaaaaatgctagaagttgcggttacatgctccactaagatgggattgtctcgttgggagtattatgttggaatagacgaaaatactgccgaacggagaagaaaaatatggtggaaaatatacagtctggaaaagcgttttttaactgatcttggtgatttatccttaataaatgaacatcaaatgaattgtctcttgccgaaggatttcagggacatgggattcattaaccataaagaatttttaacgaaaattggtacgtcctctttatcaccgtcatcgcccaagctaaaaaacttgtcattgtccaggcttattgaatatggtgagttagcgatagcccaaattgttggagattttttttcagagactctttataatgagaaattcacgtctttagaagtatccgttaaacccacaattatcagacaaaagttattggagaaagtttttgaggacattgaatcttttaggttaaaattggccaaaataaagcttcacacctcaagagtttttcaagtagctcactgcaaatatccagaatatccaaaaaacgatctaattgaagcagctaaatttgtaagttaccataaaaatacatggttctccatcttgggtgctgttaacaatcttattgctaggctatctgaagatccagaggtgataactgagcaaagcatgaaatatgcgaatgaaatgtttcaagaatggagggaaattaatcaattcttaatacaggttgatactgattttattgtttgggcatgtttggacttttatgaactgatatttttcgtgatggcttcaaaattttatgtggaagacccgcacatcactttagaggatgttatcaacactttgaaagtttttaagagaataactaacattatttctttttttaataataatttggacgagaaggattatgattgtcaaactttcagggagttttcgagaagttcgagtttggttgccatatccataagaatcatatttttaaaatactgctatgccgaacaaattgatagagccgaattcatcgaacgtttgaaagaagttgaaccgggtctaagtgaccttttgcgtgagttttttgatacccgctcttttatttacaggtacatgttgaaatccgttgaaaaatcaggctttcatttaataattagaaaaatgttagaaagcgactataaatttttgtatagagacaaattggccactggtaatattccagaccaaggaaattcaagccaaatttctcagttgtatgacagtactgctccttcatacaacaatgcttctgcctcagcagcaaactcaccgttgaagttatcgtctttgttgaactctggagaggaatcgtacactcaagacgcatcagaaaatgttccatgtaatctgcggcatcaagatcgatcgttacaacagacaaaaagacaacattctgcgcctagccaaataagcgctaatgagaataatatatacaacttgggtactttagaggagtttgtcagcagtggtgacctgactgatttatatcatactctgtggaatgacaatacttcatatcccttcttatga

SEQ ID NO: 207 - DNA, 1515 bp, Saccharomyces cerevisiae
atggcgtttttaagctattttgccactgagaatcaacaaatgcaaacaaggaggttgccaagaactgctgaaggttctggtggctttggtgtgttgttgatgaatgaaattatggatatggatgagaagaagcccgttttcggtaaccattccgaggacatacagaccaaattggacaagaaattaggacctgagtatatctccaagagagttgggtttggaacaagcaggattgcatacatcgaaggttggagagtaattaatcttgctaatcaaatctttggatataatggctggtctacggaggtaaaaagtgtagttatcgattttttggatgagcgacagggaaagtttagcatagggtgtactgcaattgttcgtgttacgttgactagcgggacttatagggaagatattgggtatggtaccgtggagaacgaaagacggaaacctgccgctttcgaaagggccaagaaatctgccgttacggatgccttgaaaagatctttgagagggtttggtaatgctctaggaaattgtctttacgataaagattttctggcaaagatcgataaggtgaagttcgatccgccagattttgacgaaaacaatttgtttaggccaacggatgaaatcagcgaaagctcaagaacgaatactttgcatgaaaatcaagaacaacaacaatacccgaataaaagaaggcaattgactaaagttacaaataccaatcccgactcgacgaagaacctggtgaaaatagaaaatacagtaagtcgaggtaccccaatgatggccgcacctgctgaggctaacagtaaaaacagcagtaataaagatactgatctcaaatctctcgatgcttccaaacaggatcaagatgaccttctcgatgattctcttatgtttagcgatgattttcaagacgacgacttgataaatatgggcaacacaaacagtaatgttttaacgacagagaaggatcccgttgtagctaagcaaagcccaactgctagctcaaacccagaggcagaacaaatcacctttgttacagctaaggctgcaacttccgtacaaaatgaacgttatattggtgaagagagcatttttgatcccaaataccaggcacaatccattaggcacaccgttgatcagactacgtccaagcatattccagcgagtgtgctaaaagacaaaacgatgaccaccgcgagggattctgtctatgaaaaatttgcaccaaagggaaaacaattgagcatgaagaacaatgataaagaactggggcctcatatgctagaaggggctgggaatcaagtaccgcgtgaaaccacaccaattaaaacgaacgctacagcttttccgcctgcagctgctccacggtttgcgccgccttctaaggtagtacatcctaatggaaatggtgcagtgccagccgttccgcaacaaagatcgacacgaagagaagttggaagaccaaagatcaatcccctgcatgcacgcaagcctacttga

SEQ ID NO: 208 - DNA, 1092 bp, Saccharomyces cerevisiae
atgggaatgaagtacgtattgcctttgcgactaattggtctagcgtacctgttggtgctatttcaggtgcatagggtaactgggtgggagttgtcatatgagcagtaccatgcagcgcatctgaacgaagctatcaacccagacagcggttggaacaaaagtaccaagaacctgctgttgccttttaacagaacgcgcgtacccggatcggaaggctcgcgcgagatccagcgcttcatcatcgagcacttcaacaatacgctggcgggagaatgggccgttgagacgcaagcctttgaggagaacggttaccgcttcaataaccttgttatgacattacaaaacaatgcgagcgagtacttagtgctcgctgctcattatgataccaagatagcgcccacggggatggtgggcgctatcgacagtgccgcctcgtgtgccgcgctgctatatacggcccagttcctaacgcacatcgcgtgccacgagcgcacgaaagagtacaatgacttagagtcgaacactgtagtatcgaattctaccttgggtgtaaagatcgtattctttgatggagaggaggccattgaagagtggggccccgaggactcgatttatggagcacgccgattagccgcccaatggcttgctgacggcacgatgacaagaattcgcctattatttcttctggatcttttaggaagtggcgaagaggagccgctagtgcccagctactatgcagagacacatcaagaatatcagctgctcaatcgaatagaggatgacttgttatttcgacgtggagatgaaatcaacggcgaatcggcattagccgccgaagtcgcgcgtcaacgcaaacatctggaccccacggactatcgatttttagggctcgggcattcggtcatcggagacgaccacacgccattcctggccgccggagtacccgtattacatgcaatcccgctaccattcccaagtacatggcacaccgtggatgatgacttccggcacttagacgccgcggagactcgtcactgggcgctgcttgtgtgcgaatttgtagtacagtcactacgctcccgtaaccagtga

SEQ ID NO: 209 - DNA, 1800 bp, Saccharomyces cerevisiae
atgaagatcacagaaaaattagagcaacatagacagacctctggcaagcccacttactcattcgagtacttcgtcccgaagactacacaaggtgtacagaacctgtatgaccggatggaccggatgtacgaggcttctttgccccaatttattgacatcacctggaatgcaggcggtggacggttgtcacatctgtccacggacttggttgcgacagcgcagtctgtgcttggtttggaaacgtgcatgcaccttacctgcaccaatatgcccatttcgatgattgacgacgctttagaaaacgcttatcactccggttgccagaacatcctagcgctgagaggagatcctcctagggacgcagaaaactggactcccgttgaaggtggcttccagtatgccaaggacttgattaagtatatcaagtccaagtacggtgaccatttcgctatcggcgttgccggctacccggagtgccatccggagttgcctaacaaagacgtgaagcttgatctcgagtatttgagcagaagatcgaccggcggcgacttcatcatcactcagatgttttacgatgttgataatttactcaactggtgttcccaagttagagctgcgggcatggacgtgcccattattcccgggatcatgccgatcactacctacgcggccttcttgagaaggatccaatggggccaaatctccatccctcaacatttctcgtcccgattggatcctatcaaggacgatgacgagttggtccgtgatatcggaactaacttgatcgtggaaatgtgtcaaaaattgctcgacagtggttacgtttctcacttgcacatctacaccatgaacttggaaaaagcgcctctcatgattctggaaagattgaacattctacctacggaatcagagttcaatgcacatccattggccgtgttgccatggagaaaatctttgaatccaaagcgtaaaaacgaggaagtcagacctatcttctggaagagaagaccttactcctatgtcgcaagaacctctcaatgggccgtggacgaattccccaacggtagattcggtgattcgtcttctcctgcgttcggtgacttggatctgtgtggttcagacttgatcaggcaatcagcgaacaaatgtctcgaattatggtccacccctacttccatcaacgacgtcgccttcttggtcatcaactacttgaatggaaacttgaagtgtttaccttggagtgatatccccatcaatgatgaaataaatccaatcaaagcacacttgattgagctgaaccagcattctatcatcactataaactctcaacctcaagtcaacggcattaggtccaatgacaaaattcatggttggggacccaaggatggttacgtttaccagaagcaatatttggaatttatgttgcccaagactaagttgcccaagttgattgacaccttgaaaaacaatgagttcttgacctacttcgccatcgactctcaaggtgacctgctaagtaatcatccagacaactccaagtccaacgctgtgacttggggtattttccccggcagagaaattcttcaacctaccattgtcgagaaaatttcgttcttagcgtggaaggaggagttctatcatatcttgaatgaatggaaactaaacatgaataaatacgataaaccgcatagtgcccaattcattcagtccttgattgacgattactgcttggtcaatattgttgacaatgactacatttctccagatgatcaaatccattccatcctactaagcctataa

SEQ ID NO: 210 - DNA, 2772 bp, Saccharomyces cerevisiae
atgaaatccgatttcaagttctctaaccttttaggtacggtctacaggcaaggtaacatcaccttttccgatgatggcaagcaactactctcaccggtggggaatagggtcagcgtgtttgacttaatcaacaacaaatcgttcacgtttgaatacgagcatcgcaaaaatattgctgccattgatctgaacaaacaaggcacattgctgatttctattgacgaggacggtcgcgccatccttgtcaatttcaaagcccgtaacgtgcttcaccatttcaacttcaaagaaaaatgctccgctgtgaagttcagccctgatgggagactctttgcattagcctcaggcaggtttttacagatttggaagactccagatgttaataaagacagacagtttgctcccttcgtccgccatagggtgcatgcgggacactttcaagacataacgtctttgacgtggtcacaagattccagatttatccttacgacttccaaagacttaagcgcaaaaatatggtccgtagattcagaggaaaagaaccttgcggcgacaacatttaatgggcacagagactacgttatgggtgcgttcttcagtcatgatcaggaaaaaatctacactgtaagcaaagacggtgctgtctttgtctgggaatttaccaagaggccatccgatgacgacgacaatgaaagtgaagacgacgacaagcaagaagaagtagatatttcgaaatacagctggagaatcacaaagaaacattttttttacgcaaaccaagccaaagtaaagtgtgtcaccttccatccagcaacaaggcttttagctgtcggatttactagtggggaattccgtctttacgatttgcctgatttcactttgattcaacagctttctatggggcaaaacccagtcaacaccgttagcgtcaaccaaaccggcgaatggctggcgtttggttccagcaaactgggccaattactagtttacgaatggcaatcggaatcgtatatcttgaagcagcagggccatttcgattccacaaatagtcttgcatactctccggatggttcacgtgtagtgacagcatccgaagatgggaaaatcaaagtttgggacattacatcagggttttgtttggccacttttgaagaacacacctcttcagttactgctgtacagtttgcgaaaaggggtcaggtcatgttctcatcatcgttagatggtacggtgagagcgtgggacttaatcaggtatcgtaattttagaacattcactggtactgaaagaatccaattcaattgtttagcggtggatccatcaggtgaagtggtttgtgccgggtccctggacaattttgacattcatgtttggtccgtgcaaactggtcaattattagatgctttgtccggacatgaaggccctgtttcgtgtctttcatttagtcaagagaacagtgtcttagcttctgcatcatgggataaaacaattagaatctggtccatatttggtagaagccaacaagtagaacctatagaagtttattccgatgttttagccttatcaatgagaccagatggtaaagaagttgcagtatctaccttaaagggtcaaatatccattttcaacatagaagatgccaagcaggtgggcaacattgactgtagaaaggatataatatctggtaggtttaatcaagataggttcactgccaaaaattctgaacgatccaaattttttactacaatacattacagttttgatggtatggctattgtggctggtggtaataataactccatttgtctatatgatgttccaaatgaagtcttgttaaaaagattcattgtgtccagaaacatggctttgaatggtactctcgaatttttaaacagtaagaaaatgactgaagcaggttcattagatttgattgacgatgcaggcgaaaattcagatttggaggatcgtattgataattctttaccagggtctcaaagaggtggcgacctgtccacaagaaaaatgagaccagaggttagagttacttcggtgcaattctccccaacggcgaatgcatttgccgctgcttcaacggaaggtttattgatatattccaccaatgacacgatattatttgatccctttgatctggatgtggacgtcaccccccattctactgtagaggcgctacgagaaaagcagtttttaaatgcattagtaatggcgttcaggttaaatgaagaatatttgatcaataaagtctatgaagccatacctattaaggaaatccccttggttgcaagtaatattcctgcaatatatttaccgaggattctgaagttcatcggtgattttgccattgaatcccaacacattgagtttaacctaatttggatcaaagctctattatctgcgagcggtggttacataaatgaacacaaatatctcttctcgacggctatgaggtcgatacaaagatttattgttagagtggctaaggaagtagtcaataccactactgataacaaatacacctatagatttttggtatcaactgatgggtccatggaagatggcgcggctgatgatgacgaggttctattaaaagatgacgcagatgaagataacgaagagaacgaagagaacgatgtagtcatggaatctgacgacgaggaaggatggattggtttcaatgggaaggataacaaattacccttgtctaatgaaaatgattccagtgatgaagaagaaaatgagaaagagcttccttga

SEQ ID NO: 211 - DNA, 369 bp, Saccharomyces cerevisiae
atgggtgaaatgctagagaggcaaaaaaaaaggttgccaagtaaagcgaagtatttgaagtatactgcaagcatcaccgaaacaggaaatcacgaagctgactcatctgtgattttccgtccccaccatagtgatgtaacatgcagtaacgcacggcgggccgaaagtcggactttaccccagatttgtagttgtatcctattggatcacgggcgacggacaagacccgaagtgcggaccggcatggtcagcttgcacggaagctttaagggtttcccttgtttcggcattagaagaggcatttcgcacgttttaccgggtcagaaacttcgaggaagctgtgacaattggaaaaaaaggcaaaactaa

SEQ ID NO: 212 - DNA, 2610 bp, Saccharomyces cerevisiae
atgactgaaagtgctatagatgaccaaaggtttaatcttacaaaggagttacaacgacactcatgcagagatcaagggaaaataacacaaaaggatgatgctttagattttataagttacagttcttttcaatcctcttttaatactgaccaaaaaagcgcgaacaatggaagtactgtgagaagaagcataaggtcgatttttagaagagcagccgaattgcctagagtccatatggggcctcttacttattcacatgggataaatgagcttgttaacaagaaattaagaaaagactgtgatctcagcacgctatgtcgcgtattgcaaagaggaatcaggatgattaggatgacaagaagaagaaggaagttctatgaatttaaattaatcaataacaacgggcaaataatatggaaagatggttcgaagtatctggaattagactccgttaaagacatcagaatcggtgatacggcgagtacttatcaagaggaagtagatccgaaaagattgagatcggacagtaaactttggattgctattatttataaggtttccaacaaattgaaagcgttacacgtagttgctttgaatgaattggactttaacacattcttaagctgcatttgcggtttagtgaagttaaggagggaattaatggaaagcatacttttgcctgataattcgcaattcgctaggatacattggcaaattactgtttctgaaaaagaggaagatgagaaaaaggacacattgagctttgcagatgtgaagaaactatgtgataaatttcatatttatgtgtcaactggtcaattgttagagtttttccaattagcagacatcaatcataacggactattaaattattttgaatttgaaaagttcattaaaatcttaaagaataggaaagaggtaaatatgatttggtctaaatttacaaaacctccacactcccacttatcatttgaaaatttttttcaatttttaattacagagcagcatgagcaagtggatcgtcaaactgcatggtcatattttattaagtacagagaaccgactcagctgacgatggggcaagatggttttaccaagttcttgaaggagcaaccatatttggtggaggttaaagaggagttatattcaaagccattaaaccattattttattgcatcttcacataatacttatttattggggaaacaaattgcagaaactccatctgtggagggatatattcaagtcctacaacaaggttgtaggtgcgtagaaattgatatatgggatggtgaaaatgggccagtggtatgccatggatttttaacgtcagctattcccttaaaaacagttatacgcgtgataaagaagtacgcttttataacgtctccgtatcctttgattatttcactggaaataaactgtaacaaggataatcaaaaattggcaagcctgataatgagagaggttttagcagaacagctgtactttgttggcacaagaactgataaactgccatcaccaagggaattaaaacataaaatactgttgaaatccaagaagacgagtgaagcaactagaggtcttagcgttaatgagccatttccatcttcttttagttcttcttacgaatcagctaatgaacaggaattaagaatgaaagatgactccacgaacagtagtagcgcaacaaattcttctagtatgcaacgcatcaaaagaattggattaaaaaagcacgctgatataattaatgatgtttctaacatttctggaatacatggcatcaagttcaggaatttctctttaccagagtccaaaacgatagcgcattgtttttcactgaatgagcgcaaagtagaatacatgataaaagacaaacacttaaaattatcgttggataaacataatagaagatatttgatgagagtctatcctcacgttttacgatacaaatcatcaaattttaacccaatacctttttggaaggccggtgtacaaatggtggctacgaattggcaaactaatgatattggacagcaacttaatctggcaatgtttcaaatattagatcaccaacctgatggaagttttaaatcaggatacgtgctaaaaccaaaaaagttgctacctgtagtaacaaaggcgaaaatgattccattaatttacgaacattttgaaaatggtagtgatcctgttactgttaaaattcgaattttatctacacagttattgcccagattgaatgatacatcgccaagcagaaataacaccaattcctttgttaaagtggagtttcataccgatgacgagccgacaatgcccatctcaatcgataagggtacaaggatttctgccactgaagcatccactaagagttctcaagggaatggattcaacccaatatgggatgctgaagtttctatcacattgaaagatacagacctcacatttataaaattcatggttatctctgaagagacccagattgcatctgtttgccttaagctgaactatttgaggatgggatatcgtcacattccgttgtttaacatggagggggaacaatacatattttgcactttatttattcatacacaaattttatag

SEQ ID NO: 213 - DNA, 1815 bp, Saccharomyces cerevisiae
atggctgaactgagcgaacaagtgcaaaatttaagcatcaacgacaacaacgagaatggttatgttcctcctcacttaagaggaaaaccaagaagtgccagaaataacagtagcaactacaataacaacaacggcggctacaacggtggccgtggcggtggcagcttctttagcaacaaccgtcgtggtggttacggcaacggtggtttcttcggtggaaacaacggtggcagcagatctaacggccgttctggtggtagatggatcgatggcaaacatgtcccagctccaagaaacgaaaaggccgagatcgccatatttggtgtccccgaggatccaaatttccaatcttctggtattaacttcgataactacgatgatattccagtggacgcctctggtaaggatgttcctgaaccaatcacagaatttacctcacctccattggacggattgttattggaaaacatcaaattggcccgtttcaccaagccaacacctgtgcaaaaatactccgtccctatcgttgccaacggcagagatttgatggcctgtgcgcagaccggttctggtaagactggtgggtttttattcccagtgttgtccgaatcatttaagactggaccatctcctcaaccagagtctcaaggctccttttaccaaagaaaggcctacccaactgctgtcattatggctccaactagagagttggccacccaaattttcgatgaagccaagaaatttacttatagatcctgggtcaaggcctgcgtcgtctacggtggttctccaattggtaaccaactaagagaaattgaacgtggttgcgatcttttagtcgctactccaggtcgtttgaatgacttgttggaacgtggtaaaatttctttggccaacgtcaagtatttggttctagatgaagctgatagaatgttggatatgggtttcgaacctcaaattagacatattgtcgaagactgtgatatgactcctgttggtgaaagacaaactctgatgttctcagctacttttcccgctgatatccaacatttggcccgtgatttcttaagtgactacatctttttgtctgttggtagagtcggttctacttcagaaaacattactcaaaaagtcttatacgttgaaaatcaagataagaagtcagccttattggatctattgtctgcatccactgacggtttgactttgatctttgtcgaaactaagagaatggcagatcaattgaccgatttcctgatcatgcaaaactttagagctaccgccattcatggtgaccgtacccaatctgagagagaacgtgccttggccgccttcagatctggtgccgctactttattggttgccacagctgtcgcagctagaggtctagatattccaaacgtcacccacgttatcaactacgatttaccaagtgatgtcgatgattacgtccatagaattggtagaactggtcgtgccggtaacaccggtcttgccactgcctttttcaacagtgaaaacagtaacattgttaaaggtttgcatgaaattttgactgaagctaaccaagaagtcccatcattcttgaaggacgctatgatgagtgctccaggtagcagaagcaacagccgtagaggcggtttcggtcgcaacaacaacagagattaccgtaaggccggaggcgctagcgcaggcggctggggctcttcaagaagcagagataactctttcagaggcggtagtggctggggtagcgattccaagtcttctggctggggtaacagcggtggttcaaacaactcttcttggtggtga

SEQ ID NO: 214 - DNA, 1203 bp, Saccharomyces cerevisiae
atgccatttgtaaaaggttttgagccgatctccctaagagacacaaacctttttgaaccaattaagattggtaacactcagcttgcacatcgtgcggttatgcccccattgaccagaatgagggccactcaccccggaaatattccaaataaggagtgggctgctgtgtattatggtcagcgtgctcaaagacctggtaccatgatcatcacggaaggtacgtttatttcccctcaagccggcggctatgacaacgcccctgggatttggtctgatgagcaggtcgctgagtggaagaatatctttttagccatccatgattgtcagtcgttcgcgtgggtacaactttggtctttaggctgggcatccttcccagacgtattggcaagagacgggttacgctatgactgtgcatctgacagagtgtatatgaatgctacgttacaagaaaaggccaaagatgcgaataatctcgaacatagtttgactaaagacgacattaaacagtatatcaaggattacatccatgcggctaagaattctatcgcggctggcgccgatggtgtagaaattcatagcgccaatgggtacttgttgaatcagttcttggatccacattctaataagaggaccgacgaatacggcggaacgatcgaaaacagggcccgctttacactggaggttgtcgatgctcttatcgaaactatcggtcctgaacgggtgggtttgaggttgtcgccgtacggcacttttaacagtatgtctgggggtgctgaaccaggtattatcgctcaatattcgtatgttttgggtgaattagagaagagggcaaaggctggtaagcgtttggcctttgtgcacctcgttgaaccacgtgtcacggacccatcgttggtggagggcgaaggagaatattccgagggtactaacgattttgcctactctatatggaagggtccaatcatcagagctggtaattacgctcttcatccagaagtggttagagaacaagtaaaggatcccagaaccttgataggctatggtagattcttcatctctaacccagatttagtctaccgtttagaagagggcctgccattgaacaagtatgacagaagtaccttctacaccatgtccgcggaaggttataccgactacccaacatatgaagaggcagtagatttaggttggaacaagaactga

SEQ ID NO: 215 - DNA, 354 bp, Saccharomyces cerevisiae
atggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgagaaaaaaaatataaaagagatggaggaacgggaaaaagttagttgtggtgataggtggcaagtggtattccgtaagaacaacaagaaaagcatttcatattatggctga

SEQ ID NO: 216 - DNA, 1575 bp, Saccharomyces cerevisiae
atggaacaccaagcacttcgaaggcttgtactgtactgccccaatttcatccgacgtggtgctcttaggcaaaatatgactagagtgagctgtagacatatgtcaggcaagggtggagggagagatgagaaaggtgattgcaatgaagaaaaggattcttccaaagatttggggagggtaccgtcgaagatgaaacgagcatatgatggtgaaacagttattaaagagggagattcgcatgctgagtcgctagcgcagcagggaaagcagcccacagacctcgcatataacagcagatcgaagatatctggttctaatttgcatttattggttcctagagttgcgtctacagactatatttcgaataaagaggttcacacggagggcctgtttgccggctatcgacccttgtttctggggaactcaggttttccgtctgatgcaagaaagggtaaaaactttcatgagttagacgacgttcttcccaatatacaggtagtggacgcttccgagaaagatggcaaactcaatgtgcaggagattattgaggacttacaaagaacaagtttgagagaaagcattcatagtatggaacagttaccatcttcgcacaaacgtaaacccgtaataccgtgggacgcatctataagtggcatggtttataatgacatgcctttcaaatatgtgcccaaaaatattattctgaaaatgaagccatttaaacttttgcgtattgagagaaaaagtcaagcgaagaatgcaagaaagcctactatgataaaacttcagtttcacaatcgaagaatcaatgacaccccagagttagtgaatttataccataataaatcccgtttgcacgagtcactttacaatacaaaaccccttcaagaatctggatattcaagtgcaaatacaagtaaaagacagaaaatgttaaaagcaagaagcgactttgaacataaacagaaaaattatgcatacaaacacacatttatcaaaaatgatcaggaactgttccgcaatgaactaactaagttaaataagatacttgctagagaattcaaaaaattgacaaagctatccatacataatgagttcaagagagaacacttgcccctggccgtttatgtgagcaaatcaaagggcacaaagaaactgtttagaagatcactgaagatgaaaatcatggaccacatatacccagtttataccacgatattgtcaactttaacaaattccagagactctaagaaatttgaaaacaaaatcaaggcgtatattgaaaaaatcatagtgcggttatcagatgaagtaccatccacatattttttccaagatggcgtagattgtattattcaaccaagtccgattcataatttcaagagaatgcattggttaagatacaccaagaggcacaataccttttgggggaggactatacataaggacgttcaagtcagcttcaatgacaagtatgttgttactaggagcggcgtgaggtatacgaggtatcccactaatttgaatacacaattattggaaactgcatttgaagaatgggactactatgagtga

SEQ ID NO: 217 - DNA, 1557 bp, Saccharomyces cerevisiae
atggcgcccatctttagaaattaccggttcgctatcggtgcttttgccgttattatgctcattttgttgattaaaacatcttccatcggtccaccttctattgcacgtacagttactcctaatgctagtattcccaaaactccggaggacatctctatcttgcccgtcaatgatgaaccaggttaccttcaagattcgaagactgaacaaaactatcctgagcttgccgatgctgtgaagtcacaaacaagtcaaacatgcagcgaagaacataagtatgttatcatgatcgatgccggctctaccggttcccgagtacatatatacaagtttgacgtctgtacttccccacctacattacttgatgaaaaattcgacatgttagagcctggtttatcttctttcgataccgattccgttggtgccgctaactcccttgacccattactgaaagtagcaatgaactatgtccctattaaggcaagaagttgtactcccgttgcggtgaaagctactgcaggcctaagactcttgggtgatgccaaatcttcaaaaattttgagcgctgtaagggatcatttggagaaggactatcctttcccagttgtcgaaggtgatggtgtttccatcatgggcggtgatgaagaaggtgtcttcgcctggattactacaaactacctattaggtaatatcggtgctaatggccccaagttacctactgctgccgtttttgacttaggcggagggtctacacaaattgtttttgagcctactttcccaataaatgaaaaaatggtcgatggtgagcataaatttgatttgaagtttggtgatgaaaattacaccttgtaccaattttctcatctaggttacggtttgaaggaaggaagaaataaagttaactctgttcttgtggaaaatgcattaaaagacggcaaaatattgaagggtgataacactaagactcatcaattgtcatctccatgcctaccgcctaaagttaatgccacaaatgaaaaggttacattagaatccaaggaaacttataccattgactttatagggccggacgagccaagtggtgcacaatgtagatttctgactgatgaaattttgaataaagatgctcagtgccagtctccaccatgctctttcaatggggttcaccaaccttctttagttcgtacattcaaagaatcgaacgatatctatattttctcttatttctacgacagaacccgtccattgggtatgcccttgtcctttactttgaatgaattgaacgatttggcaagaatagtgtgtaaaggcgaagaaacttggaatagtgtcttcagtggcattgcggggtccctagatgaattggaaagtgactcgcacttctgtttggacttatcttttcaagtgtccttattacatacgggatatgacattccattacaaagagaattgagaactggaaagaaaattgccaataaagaaatcggttggtgtttaggtgcgtcattaccattgttgaaagctgataactggaaatgtaaaattcaatcagcttga

SEQ ID NO: 218 - DNA, 552 bp, Saccharomyces cerevisiae
atggtacctctggcaatcttggttgggacacccaaagcttggaagaaagaagtcttacctggttccataccagtgttgacggctctaacccagatgtcttctggagcaacggcaccagctctggctggagcagcaactctgttagagacaataacgttcttgatttcagtcaatggttcgttagtgaaaacgaaaccaacgttacctttgacaaaaggcaacaacttttcgaagtctggcaagtcggataagaaacctctgatggctcttctaaccatggtgttcttacccatcaagacgacagctctgcctctcaattcctttctgacttcgtgcatttgttgggaagaaacattgtcaacaccaacaacgaacaaagacttgtattcttccaagtattctcttaatttagcaaagtattcagctttcttttcacgaatgcctcccatttcaaacttattatacgtatttattagactgtttgcaggatgtttaaaggtattccgcttatgtatcttatggctgaaacttgaaaaaagaatcgagaattag

SEQ ID NO: 219 - DNA, 663 bp, Saccharomyces cerevisiae
atggaggaagaagaattaagtaaattgttggccaatgttaagatagatccgagcctaacatcaagaattagtcaaatagacagcttcaaactgtcggaattgatggttctaaagacagatattgagacacaactagaggcgtatttcagtgtgcttgagcagcaaggcatcggcatggactctgcgttggtgacgccagacgggtatcctcgttcggatgtcgatgtattgcaagtcactatgatcagaaagaatgttaatatgctgaagaatgatttaaatcaccttttgcaaagatcacacgtcttactaaaccagcactttgataatatgaacgttaagtcaaaccaagatgcaagaaggaataacgacgatcaagctattcagtataccatcccttttgcatttatcagtgaggtagtacccggtagcccttcagataaagcagacataaaggttgatgataagctgatttctattggtaatgtgcatgcggcaaaccactctaaacttcaaaacattcagatggttgtaatgaaaaatgaagacaggccacttcccgtccttctcttgagagaagggcaaatcctaaagacatcgctaacaccttcgagaaactggaatggtagaggtcttttgggttgtaggatacaagagctataa

SEQ ID NO: 220 - DNA, 2295 bp, Saccharomyces cerevisiae
atgcctgccaaaatacacatttctgcagacggtcagttttgcgataaagatggcaacgagatccaattgcgtggtgtcaatttggatccgtcagttaaaatccctgcaaagccattcctatccacccacgctcccatagaaaatgacacgtttttcgaggatgctgataaagtcagtttcatcaatcaccccttagttcttgatgatatcgaacagcatatcatcagattgaaatcactgggttacaataccattcgtttacccttcacctgggaatctcttgaacatgctggtccaggacagtacgattttgactatatggattatatcgtcgaggtactaaccaggattaacagcgtacaacaaggtatgtacatttatttggaccctcaccaagacgtctggtctaggtttagcggtggatctggagcaccgctatggaccttatactgtgcagggtttcaacctgcaaacttcctggccaccgatgctgcaatcttacataattattatattgaccccaaaacgggcagggaagttggcaaagatgaagagtcctaccctaagatggtttggcctacaaactacttcaaactggcgtgtcaaacaatgtttacgttattctttggtgggaaacaatatgctcctaagtgcacaattaatggagaaaacatacaggattacttgcaaggaaggtttaatgatgcaatcatgacactgtgcgcaagaattaaagaaaaggctcctgagttgtttgagagcaactgcattattggattagagtctatgaacgagccaaactgtggttacattggtgaaacaaatctcgatgtgattccgaaagagagaaatttgaaattgggcaaaacgccaacggcatttcaaagctttatgctgggtgaaggtattgagtgcacaatagatcaatataaaaggacattttttggattttctaagggaaaaccgtgcacaatcaatcccaaaggcaaaaaagcttggctgagtgcagaggaaagagatgcgatagatgcgaagtataattgggaaaggaaccctgaatggaaaccagacacttgcatttggaaactccatggtgtttgggagattcagaatggtaaacgccctgttttactcaaaccaaattactttagccaacctgatgcaacggtatttataaacaatcattttgttgactattacactggaatttataacaagtttagggaattcgatcaagaattgtttattataatccaaccgccggtaatgaagccaccacccaatttacaaaattctaaaatattggacaataggacgatttgtgcatgtcatttttatgatggtatgacactaatgtataagacatggaataaacgaattggcatagacacctatggactagtaaacaaaaaatactcaaatcctgcctttgctgtagtgcttggcgaaaacaatatacggaaatgcattaggaagcaattatcagaaatgcaaaaggacgctaaatccatgcttggaaaaaaagtacctgtattcttcaccgaaattggtattccatttgacatggacgacaagaaagcatatattacaaatgactattcttcacagaccgctgcattggatgctcttggatttgcattagaaggaagtaatctttcgtacaccttatggtgttattgcagtattaattcacatatatggggtgacaattggaacaatgaagatttttcgatttggtccccggatgacaaaccactctatcacgatacccgagcaaaaactcctactcctgagccatctccagcctctactgtggcttcggtatccacttctacatctaaatcgggttcttcacaaccaccaagtttcataaaaccagataatcatttagatttggatagtccctcgtgcactttaaagagcgacttgtcagggttcagagctcttgatgctataatgagaccattccccatacaaattcacggaagatttgagtttgctgagtttaacttatgtaataaatcctaccttttgaaattagttggtaaaacgacacctgaacagataactgtccctacatatatttttataccacggcaccattttacaccaagccggttgtcaattcgttcatcatcaggtcattatacctataacactgactaccaggttcttgaatggtttcacgagcctggccatcagttcattgaaatttgcgcaaaatcgaagtcaaggcccaacacccctggaagtgacacttcgaatgacttaccagcggaatgcgttatcagctaa

SEQ ID NO: 221 - DNA, 3123 bp, Saccharomyces cerevisiae
atgagtaatgacagggaagtacccacactctcgcagctcaacacaactgtcagcagagataaagacgtatcggacactttgtcaccggattttgacagcaaaggaagtgcaaccgggcgtgacggtggcaatttcccaatgtatattgccattaatgagtattttaagcgaatggaagatgaactagatatgaagcccggtgacaagatcaaagtaataactgatgacgaagaatacaaggatggctggtattttggtcgaaatctgagaaccaatgaggaaggtttatatccggtggtctttactcaaaagataacagtggagaaggctccgacattgatgagagccaagtctaccaaaaggatatatagtccattaaccaatgaagatcctcttctttccagcacttttatcagtgaaaacgattcaaacagtgaactgccaaccccgcaaccaattgaaaccgccgcctctatttcgagaactgccaatggaaagatcgaaagaaacttgtctttaaagaatacaatgagtgacatagacaatgcactactggagtttaaagacgactctataggtccaccagatcgtttcatcaattcgggcagagacgaggaacatagcattacgcatgaaacaattctatcagccactgatggactggatgtagtcgaatctaacagtaagccaacaacgagtagttctactgggttcctgaacggagatttggaaaatcaagctactttaattaatggaattgatactactaaattgaaccctgtagaagcagagttttggtcacccgaagaaataacagcttattttattatggaaggatacgatgtccaatctgcctctagattccagaagcacaaaatatcgggtaaaattttgttagaattagagcttgttcatttaaaagagttggacataaattcttttgggacaagatttgagattttcaaagaaatagaaaaaatcaaagaggctattagaactaatggccgctccctgaatagagctagtaagaccaataacgctaacatttataaccaattgatgcctcccgcaaacgttgaccagagagcttcctacagaggccatgttagaaagacttcacagtcgttagaggaccttccgtcacaacagaattttatccccactcccagaaatactaggaactcctcagcttccaagcaccggcctaaatctttagtttttgattcacaagaggctaatgctaatatagctccagatgttcaaattcctcaggtggtagaggaaatggcaggtaatgaaaatttgtttgtttctccgaggagagcccccaaacccccatcttaccctagtccagcacaacctccaaaatcgcccctattgaataacacaaggacgtcaccttctcctgctcaactttattcatggcaatcacctactttatctttctcagggcctaaaagaacttcttatatcgatcaatattcttcatcagattctaatttcaattcccgttccgcactcccaaagaacaaccaaggcggtgggaaggcgttgtcacctattccatcccccacccgtaattctgttagaaatgaagatagtgaaggcaagctaacatcgtcttcgaagaggaattctgtcccttattatggatacgctcctgaatcttcttcggatagaaaatcctcttgttccagccatgaggaagagcagtttcaagaaacaatgaacacattcgaaagacccacgtccagtatatacgctgatggatctaccattgcatccataagtaatgacaaattggcacatgagaaggaggggaagaaaaaaccaacgagacactcgtcttcattatcttctaaatcaaaaagcgattccaggaggaactcgtctttaaagagaagcagcagtgcatcgcgaactagttcattcaaaaaaagttccttcatgctaagtccctttaggcaacaatttactgataatgctgctcgctcttcaagtcctgaagagaatcccataacctcaatgccgtcagaaaaaaacagctcaccgatagttgataaaaagtcttccaaaaagagtagatctaaaagaagatcagttagcgcaaaggaagctgaaatctttaccgaaactgtgaaagatgataaaaataagaggtctgcgagtgaggctattaaaggtgaaacgctcaagggcaaaagcttgcgtcaaatgaccgctagacctgtagccaagaaaaagcaaacttctgcatttatagaaggtttaaggagtattagtgttaaagaggcaatgaaggatgctgacttttctggttggatgagcaagaaaggcagcggtgccatgagtacttggaagacgagatttttcacattgcatggtactagattgtcatacttcagctccactacggacacgagagaaagaggtcttatcgacattactgctcatcgcgttgtgcctgctaaggaagatgataaactagtttcattatatgcagccagtacaggtaaaggacggtattgtttcaaactattacctccgcaaccaggatcaaagaaaggtttgacatttacacaacctcgcacgcactattttgcagtagataataaagaagagatgagaggttggatggctgcactaattaaaaccaccattgatatcgacacatcagtgccaattatcagttcctatacaacacctacggtttccttgagcaaagcgcaagagatgttagcagaagcgagagaagagaccaagctaagggaacagcaaatgctagagaacgaggaagatgaggaccagtttttatgggatcaacagcagcttcaacagcagcaacatgacaataatcaagggcaagctgatcgcacaatatcagcgtcaacccaacgaacttccgacgaggataatactatatctactccgaatttgtcctctgctaacaatacaaccattggctcaaatggattttccagtccgttcttactagcttccggattgttatcgcctggagtggctcgcaatagtagtatgcgtggaacagagaaaaagggtaaattctcaacggaagaggattacttcggggataattcaaaacataaaaccgacaaaatataa

SEQ ID NO: 222 - DNA, 2682 bp, Saccharomyces cerevisiae
atgtccagggaaggttatccaaactttgaagaggtagaaattcctgactttcaggaaactaacaacaccgttccagatcttgatgatttagaattagagtatgaccaatataaaaataatgaaaataatgacacgtttaatgataaggacttagagagcaattctgtagcaaagcacaacgcagtgaacagctcaaagggcgtaaaaggctcgaagattgactactttaatccttcagatgtctcgttgtatgacaattccgtttcccaatttgaagaaacaacggtatcgctaaaagagtactatgaccacagtatacgatctcatctcacggtgaaaggagcatgtagttatcttaagagtgtttttcccatcatcaactggctaccacattacaattttagctggtttactgcggatcttattgcaggaattaccattggctgtgttctcgtgccgcaatccatgtcatatgcacaagtcgccacgctaccagcgcagtatgggttgtactcctcgtttattggtgcttactcctactcttttttcgctacatcaaaagatgtttgtattgggcccgtggctgtcatgtctttgcagaccgccaaagtcattgcggatgtcacggcaaaatatcctgatggagattctgccataactggtcccgttattgcaacgactctagcgttactatgtggtatcatttcggcagcagttggcttcttgcgtctagggtttcttgtcgaactgatttccttaaatgcagtcgctggatttatgactggatccgcgtttaatatcttatggggtcaagttccagcactaatgggttacaatagtttggttaacacgagagctgccacctataaagtggtcatagagaccttgaaacatttaccagataccaaactggacgcagtttttgggctaatcccgcttttccttctttatgtttggaaatggtggtgcggaacatatggaccaaggttgaacgatagatacaactccaaaaacccaaggttacacaaaattatcaaatggacatatttttacgctcaggcttccagaaatggtatcattattattgtattcacttgtattggttgggcaatcacaagaggcaaatctaaatcggagaggcccatcagcatcctaggctcagttccatccggtttgaaagaagtcggggttttccatgttccaccaggattaatgtctaagcttggtccaaatttgcctgcatccattattgtgttattgttggagcatatcgctatttcgaagtcttttggtagaatcaacgactataaagtcgtccccgaccaagaattgattgctattggtgtctcgaaccttttaggtactttcttcaatgcttacccagcgactggttccttttcaaggtctgctttgaaggctaaatgtaatgtccgtacgccgttatctggtttgttttcgggttcatgtgttcttttagcattatattgtttgaccggcgcattcttttacattccaaaggctaccttatctgcagttatcattcacgctgtatctgatcttttggcctcttatcaaactacctggaatttctggaagatgaatccattggacttcatctgtttcattgtcaccgtcctaataacggtatttgcctctattgaagatggtatttattttgccatgtgctggtcatgtgcaatgctcattttaaaagtggctttcccagcgggaaaattcttgggtcgtgtggaagtcgctgaagttactgatgcttacgtcagaccggactccgatgtggttagctacgtgtctgaaaataacaatggtatttccactttagaagatggtggtgaggatgacaaggaaagttccaccaaatacgtcacaaattcctccaagaaaatagaaacaaacgttcaaacaaagggctttgattctccatcttcttcgattagccagccaaggataaaataccatactaaatggataccgtttgatcataaatacacaagagaattgaacccggacgttcagattctccccccaccagacggtgttcttgtttataggctatcagagagctacacctatctcaactgttccagacactacaacatcataaccgaagaagttaaaaaagttaccagacgtggtcaattaattcgccacagaaaaaaatctgaccgtccatggaatgatcctggtccatgggaagcacctgctttcttaaagaatttgaaattctggaagaaaagggagaacgaccctgaatccatggaaaacgcgcccagcacctcagtcgatgttgaaagagatgacaggccattgctgaaaatactatgcttagacttctcacaagtggcacagacagacgctacggctcttcaatcattggttgatttgagaaaggccataaatcaatatgcagataggcaagttgaattccactttgtgggtatcatttcaccatgggtgaagagaggtttaattagcagaggatttggtactctgaacgaagaatacagtgatgaatccattgttgccggtcatacaagttatcacgtcgccagagtacctcaaggcgaagaaaatcctgaaaaatatagcgtttataccgcttcaggaacaaatctacctttcttccatatcgatatcccagattttgctaaatgggatatctag

SEQ ID NO: 223 - DNA, 1908 bp, Saccharomyces cerevisiae
atgaagttagaaaatactctatttacactcggtgccctagggagcatctctgctgctttggtcatcccaaatcttgaaaatgccgccgaccaccacgaactgattaacaaggaagatcaccacgagagacccagaaaagtggaattcactaaggacgatgatgaggagccatctgactctgaagataaagaacatggaaagttccataagaagggccgcaagggccaagacaaggagtctccggaattcaacggtaaacgtgcaagtggctctcatgggagcgcccacgagggaggaaagggcatgaagcctaagcatgaaagttccaatgatgatgataatgatgataagaagaagaagcctcaccataagggtggctgccacgaaaataaggtggaggagaagaagatgaaaggtaagaaagtcaagggcaagaagcaccacgaaaagacgttggagaaagggaggcaccacaacaggctggctcctctcgtgtccactgcacaattcaacccagacgcgatctccaagatcatccccaaccgctacattatagtcttcaagagaggtgcccctcaagaagagatcgatttccacaaggaaaacgtccagcaggcacaacttcaatccgtagagaacttatctgccgaagacgctttcttcatttctactaaagacacctccttgtccacctctgaggctggcggtatccaggactcattcaacatcgataatcttttctccggttacatcggttacttcacccaagagattgtcgacttgatacgtcaaaacccattagtagactttgttgagagagactctattgtcgaggctacagaatttgacactcaaaatagcgccccatgggggttggcccgtatttcccacagagagcgcctcaacctggggtccttcaacaagtatctctacgatgatgatgccggtcgcggtgtcacgtcctatgttattgacacgggtgtcaacatcaaccacaaggacttcgaaaagagagccatttgggggaaaaccatcccacttaacgacgaagatctcgacggtaacggccacggtacccactgtgccggtactatcgcttccaaacactacggtgtcgctaaaaatgccaacgttgttgcggtgaaagtcttgagatcaaacgggtctggtaccatgtctgatgtcgtcaaaggtgtcgaatatgccgcaaaggcgcaccaaaaagaagcccaagaaaagaaaaaggggttcaaaggttccacagccaatatgtcgcttggtggtggcaagtccccagctttggacttggctgttaatgcagccgttgaagtcggtattcactttgccgtggctgctggtaacgaaaaccaagacgcttgtaatacctccccagcttctgctgacaaggccatcaccgtcggagcttccacgttgagcgatgacagagcctacttttccaactggggtaagtgtgtcgacgttttcgccccaggtttaaacattttgtccacctacattggaagtgatgacgccaccgccactttatcgggtacctcaatggcttcccctcacgttgctggtttgttgacctactttttgtctttgcaaccaggttctgatagtgaatttttcgaattgggccaggattctttgactcctcagcaattgaaaaagaagctaattcattacagtacaaaggacattttgttcgatatccctgaagacactccaaatgttttaatctacaacggtggtggtcaagatttgtccgctttctggaatgataccaaaaagtcccattcatctggtttcaagcaagaattgaacatggatgaattcattggatcaaagaccgatttaatctttgatcaagtgagagatattcttgataaattgaatattatttaa

SEQ ID NO: 224 - DNA, 3189 bp, Saccharomyces cerevisiae
atggtcgaaaatagtacgcagaaggccccacatgccggaaatgatgataatagctctaccaagccatattcggaggcgtttttcttagggttcaataacccaacgcctggattagaagctgagcactcaagcacatcgcctgcccccgagaactccgaaacacataataggaaaagaaatagaatattgtttgtctgccaggcttgttggaagtcaaaaacaaagtgtgatagagaaaaacctgaatgtggtcgatgcgtcaagcatgggttaaaatgtgtttatgacgtatcaaaacagccagcaccacgaattccgagtaaagacgccattatatcaaggttggaaaaagatatgttttattggaaagataaagctatgaagctactaacagagagagaggtgaatgaatcaggcaagagatcagcaagtccgatcaatacaaacaatgctagcggggacagtcctgataccaagaagcagcataaaatggaacctatatatgaacaaagtggtaacggggatataaacaatggtaccagaaatgatattgaaatcaacttgtatagaagtcatccaaccatgatcatgagtaaagtcatgaaaagagaagttaagccgttatctgaaaattatattataattcaggactgttttctaaaaatcctggtcacttcagtgttccttgacacttcaaagaacacgatgataccggcattgacggcaaacgcgaatattacaagagcccagcctagcgtagcaaataaccttttgaaattgaaggaaatgctaatcagacagtgtcaaaccgaagatgaaaaaaatcgtgtaaacgaattcactgatagaatactacaaaatacaaattcaaatagaaacttgaaaatcggtatgctattatcaatgctttacaattctgtcggttaccaatatctggaggatcattgccctcaaggtggcgaatattcggatttattgagaaatttgatcaatgaatgtgaagctattttgccatcttacgaaattattgaacgctacaagaaccacttttatgagtacgtttatccaagtctacctttcatcgaattagaaatttttgaagaatcattaagtcaaacaatttttccggacccaaacaacccctccaaggtgcaaatacgtatgggtagcacacatttgagagctaaggtggaaaacttgagtcttctattggttatcttgaaactctcatacatgtcaataaggtttttagatcatagtacagcagactcgagtttttatctttcaaaggaaataattgataaatacccaataccgaacgattttattttattgagtccaagatgtctagcatcggaaaattggtgtgcatgcgctaatgaaaacatcatatcatgtttactatatatctggtctttttttgctttttctcctgaagagggtgatttctttctcgagcaccccaccgatgttatcagtagtttgataatgatgctttccacctcgattggtctccacagagatccttcagatttccctcaattgatttccccgtccacctcagataaaagaaccttgaatcacagaagaatactctggttgagtatcgttaccgtttgttcgtttgaagcaagtctcaaaggtagacattctgtctcaccgatatctttaatggccttattcctaaatattaaggatcctgattctctgacggtatatatgaaccgagttaggggcgatctaagcgatatcaataatcacacacttttgagaattcataaatttacattcaagagagcccagcttgcgttactcctgtcggacttagataacttgacgatgacatactatggtagtttccatttgcattcaattgaattcataagagaaaagattgagatttttgtggaggaaaactttcccatagtaccattaaaaagtgtcgcacaggataagtcagaccttgatgacatgaatgtgatttcagaaatgaatatattatcttcagaaaattcttcttcatttcacaatcgaataatgaataaactattgatgttgagaacttcaatggccgtattcttgcattttgaaacacttatcactaaggataaaagtatcttcccattctacaagaaatactttatggttagctgtatggatgcgttgtcactaataaattatttcaataagtttttcaacggagaatatcgacacgcaatatcttctttaaccagttttaatgttacaaaatttattcagttagcactatccagcacaatcttcagcctattagggattatactaagaataggtttagccatccatatgttatcttctgaagtacaaaagttatcgggaacgacagatccaagaataaaggagttaaataccaaagtcgaaaaatttagtaccctgcaaagagatctcgagtctgctttagaaggtatatattgctctgcttcggaacatttaagattcacatacttccccgtttttaagatgttggctttattcgatgtcattgtacaaaggatgagaaagggtgaattatggcacggcatatttacgatgattcaaatggaacaaatgcattctaggataatcaagacattaagcattaccttaggagtcaaactggacaaaaaggataggctattagaggaattgatggcatgcaatcacgttgcgaattttagcgttgaagatatagatgagctgaaccgtaatatcaaaaaagagattcaaatttcttcaggattgaagccgcctgtaaacacaattgacttaaccaacggcgaaccattcggaaatgctgttcctaccttcacaaagacatggagttcatccttagataatttagaaaaactatcatcggccgctgcagttggtcagagcttggactacaacagtggtttacgtcagggtcctttggcgggtggtggttcaaaagagcaaacgccaatagccgggatgaataacttgaacaattcaatcaatgctacaccaattgtcgataactcatctggatcacaacttcctaatggtttcgatagaggccaagcgaataatactccttttccaggttattttggaggtttggatttatttgattatgactttttggtttgggcaatgactttgcttaaaaattttctttccaaactcctacctattcatttcatcaattaa

SEQ ID NO: 225 - DNA, 1077 bp, Saccharomyces cerevisiae
atggatgcaacatcgaggatggagcagcctgatgtctttgtaagcaaactctaccacctgctgcaggggaacgcttactcgaacataatacaatggtcgactgatggcagcaagctcgtcatttggaatccggaccagttcaccaaagtcatcctagagcgattttttggtattcacacctttgcagcattcgttaagcaattgagcaaatataacttccagaaggcgggccgcccggactgcgtggagttttccaacattcattttcaaaaagataacattaatagcctctcactggttaaagctcatcagtctgccgccactcccaatgtcgccgccgtcaataatatgaataagcagtgtacttttcactgggaccctttcaaagtgaactccattctaagcaaggccatcggcaagccttccttcgagaaattagtgaaaaatgttgacaggcttcagggcaatcttgatgagcttaagtcgacaaacgcagatagtctgcgtattataagggaaattaacgccagcttacagacaatctcctaccaccagtttcacgcctaccaaaccgctaacttccttcaagaaaattttgaagccatcaaaaaggttgtatgcccggactcttgtctacaacaccagcaacgccaaccaaagcgccccaaacgctactcgttgctgttactaataccaaacgcatccgaattgtcagaaacacctttgatgcgcttcgccggcgtgttcgaatttatgaactgctctttggatacggccactcagtggcacccgcagttgcatcccgaggcatacgaccttcttttcgtcaccgtgtcgcccaacatgcaacaagaacatctcatctacttcaagagactgagaaacctactcccaagctttcctgtaatagccattattaacagacccgtctcccctcaagataccagcattgctccctccaactactctcgctattatttccaccattttttgcagttggggttcagtgacatcctagttagccccttcaccccaacacaacttataacgctcctttccaaacatcttcgaacgtga

SEQ ID NO: 226 - DNA, 1698 bp, Saccharomyces cerevisiae
atgaaaagaacggtaatatcttcctcgaacgcatatgctagtaagagatctcggctggatatagaacatgattttgaacaataccactcgttgaacaaaaaatattatccaaggccaattactaggacaggcgcaaatcaattcaataataagtctcgggctaaaccaatggagattgtggaaaaactgcaaaagaagcaaaaaacgtcgtttgagaatgttagcactgtcatgcactggtttcgaaatgatctacgtttatatgataatgtgggactgtacaaaagtgttgcgctcttccagcaattgaggcaaaaaaacgcaaaagccaaattatatgctgtttatgtcatcaatgaagatgattggagagcccatatggatagcggatggaaattgatgtttataatgggggcgttaaaaaatttgcagcagtccttagccgaattacacatacctcttcttctgtgggaattccacactccaaaaagtaccttatctaattcaaaagagttcgtggagtttttcaaagaaaaatgtatgaatgtaagttcaggaacaggtacgataatcactgctaatatagaataccaaacagatgaactgtaccgtgatattaggctgttagaaaatgaagaccatagattgcaattgaaatactaccacgactcttgcattgttgctcctggattgatcactactgacagaggcaccaactattctgtgtttactccatggtacaaaaaatgggtgctatatgtaaataattacaaaaagagtacctctgaaatttgtcatttgcatataatcgaaccattaaagtacaacgaaacttttgaactgaagccattccaatattcattaccggatgaattccttcaatatatacctaaatcaaaatggtgcttgccagacgtttctgaagaagcagctttatccagattaaaagatttcctcggtacaaaaagttctaagtacaacaatgaaaaagacatgctatatttgggtggaacctctgggctaagtgtatatataactactggtaggataagcacaagacttatagtcaaccaggcatttcaatcatgcaacggacaaataatgtcaaaagcactgaaagataattcgtccacccaaaatttcatcaaagaagttgcatggagagatttttacagacattgtatgtgcaactggccatatacctcaatgggaatgccttatcgattggacactttagatataaaatgggagaataaccctgtagcatttgaaaagtggtgtactggtaatacaggcattcccatagtcgatgccataatgagaaaattactgtacacaggctatattaataacagatctagaatgatcacagcttcttttctttctaaaaacttattaatagattggagatggggggaacgctggtttatgaaacacttgatagacggtgattcgtcttcaaatgttggtggctggggtttttgttctagtacaggaattgatgcccaaccatattttagagtttttaatatggatatacaagcaaaaaaatatgacccacaaatgatattcgtcaaacaatgggttcccgaattgatttcttccgaaaataagcgtccagaaaactatccaaaacctttagttgatttaaagcatagtagggagcgtgctttgaaagtttataaagacgcaatgtga

SEQ ID NO: 227 - DNA, 2772 bp, Saccharomyces cerevisiae
atgagattctcacactttctcaaatacaacgctgtccctgaatggcagaatcattacctagattataacgaattgaaaaatttgatctacacattacagacagatgaattgaaacaagaaacgccaaccggtgacttaaacgatgacgctgactctcagactccaggtccaatcgctgatatagaaagcaacatagctgcaggagaaccatctccatcgaaaagaagatttacacataaactcaagcgtaagctctttggttctaaaacaccttcaggaagcaaaaggggagactccgacgaaaaggccatagatgggaacaatattaacgaggaaacaattgagttagacgagttatctcctcaagggaaaaccacctctttcaataagaattttatacgtaagaaattctttgaatcacgcagctcatctgtgagtagcgagggaaagacgctcttcagttcttatgatacattcgtaactaacctgagcgacgagaaattgaaagtagatgatttctacaaaagaatggaagctaagttctatgaaagatttgaccacttgattaatgatttggagaaggaaggcattgtaacaagattgaatgaaactttcaatcctgaaattcaagcattgcctcctttaagagaaattatttctggtacatcagagacacattcatctaataacccatttgaaatacactcttcaaacatcgacagtgaattgagaaataggtttgattacagcgaagaagaaatggatgaagatgatgacgttgacgtgtttgctgacactaccgacaataccgccctcttgaattattcgcaatttaacattaaatctcagaaaaaatcattattaaaacagacaataataaatctttacatagacctttgccagttgaaatcttttatcgaattgaacagaatgggtttcagtaaaattactaagaagtctgataaagtattgcacatgaacactaggcaagaattaatagaaagtgaagaatttttcaaagacacctacatcttccagcatgaaactttaagcagtttaaacagtaaaattgcacaacttattgaattttatgctgttctcatgggtcagcctgggaacgtagattcatgcaagcaagagttaaagtcgtacctgcacgaccacattgtttgggaaagaagcaacacatggaaagacatgttgggcctctcttcgcaaaataacgatataataactattgaagatgaagctgagaaacttatgcaagaaaagcttcaaattgaatatttcaagtatccattgcctaagccaattaatttgaagtttactaaaattgaaaatttggcagttcctaagctattttttgggaaaagagcaatgaaaataggcttcattatcattgtcacaggtgttttgttgggtgttaaaactttcaatgaccctgtcgaacaccggtgtatggcattggtagaatgctgtgctttcttatgggctagtgaagccattccattacacatcacaggtttattggttccccttctaactgtcctttttagggtactaaaagacgatgacggtaaggtaatgggagcagcagctgcctctacagaaatcttaggtacaatgtggtcgtcaacaattatgattttattagcaggtttcacattgggtgaagccttgtcgcaatataacgttgcgaaagttttggcatcgtggttattggcccttgcaggtaccaagccaagaaatgtccttttaatggcaatgagtgttgtattctttctttcgatgtggatttccaacgttgcctccccagtattgacatattctctattaacacccttactagatccgctggactacacttcaccgtttgctaaggcattagtcatgggtgttgcactttcggcagatattggtggtatggcttcacctatttcttcgccacagaatatcatctccatgcagtacttaaaaccttatggaatcggctgggggcaattttttgctgtcgctctgcctacaggtattctatcgatgctgtgctcctgggccttgatgatactcacctttaaaataggcaaaactaaactggaaaaatttaaaccaataaggaccagatttactataaagcaatattttatcatcattgtaactattgctactattcttctatggtgtgtagagtcacaaatagaaagtgcttttggatcgtccggtgaaattgcagtaataccgatagtcctgttttttggtacaggtctactatcaacaaaggatttcaacacattcccttggtcaattgttgttcttgctatgggtggtatagcccttggtaaggcagtttcatcttcaggcttgttggtaactattgcaagagcattacaaaagaaaattcagaacgatggtgtttttgctatcttatgtattttcggtattttaatgttagttgtgggcacttttgtctcacatactgtgtcagcaatcatcattattcccttggtgcaagaagttggtgacaaattatccgatccaaaggcagctccaattcttgtgttcggttgcgccttgttagcctcatgcggtatggggttggcttcatctggatttccaaacgttactgctatttctatgaccgataaaaagggtaatagatggctaactgtaggcgcttttatctccagaggtgttcctgcttcgttgttagcgtttgtctgcgtaattactctcggttatggtattagttcttccgtcttaaaaggtagcacttaa

SEQ ID NO: 228 - DNA, 3246 bp, Saccharomyces cerevisiae
atgtattttgataaggataattccatgagccctaggccgttattgccaagtgatgagcagaagctaaacattaatcttctaacgaaaaaggagaaattctcgcatttagacccccattatgacgcaaaagccactccacaaagaagcacttcgaatagaaacgttggcgatttacttttggaaaaaagaaccgctaagcctatgattcaaaaggccttgacgaatacggataatttcattgaaatgtaccataatcagcagagaaaaaatcttgatgatgacactattaaagaagtaatgattaatgatgaaaacggaaaaactgtcgctagtaccaacgacggcagatatgacaacgattacgataataacgatattaatgaccaaaaaactttggataatatagcgggaagtccccacatggaaaaaaatcgaaacaaagtaaagattgaacatgactcttcatctcaaaaaccaatagctaaagagtcatccaaagcccaaaaaaatataatcaaaaagggaatcaaggactttaaatttggtagtgtaataggtgatggcgcgtattctactgtaatgttagcgacgtcgattgataccaaaaagaggtacgccgcaaaagtactaaacaaagaatatttaatacgccagaagaaagtcaaatacgtcagcatagaaaaaaccgcccttcaaaagctcaataattctcctagtgttgtgcgattattttccacttttcaggatgaatcaagcctatactttctcttagagtatgcccccaatggggactttctttctttaatgaaaaaatacggttcattagacgaaacctgcgcacgatattatgctgcgcaaataatagatgccatagactacttacattccaacggtattattcatagagatataaaaccagaaaatattcttttagatggagaaatgaagatcaaactgactgattttggtactgcgaagttactgaatcctacaaataatagcgtttcgaaaccagaatacgatttatcaacaaggtcgaaatctttcgttggaactgcagaatacgtatctccagaacttttaaatgacagttttacagactatcgttgcgatatttgggccttcggatgtatacttttccagatgattgccggaaaaccaccattcaaagctaccaatgaatacttgactttccaaaaggtaatgaaagttcagtacgcctttacaccaggtttcccacttattatcagagatttggttaagaaaatcttagtaaaaaacttagaccgaagattgacgataagccaaattaaggaacatcattttttcaaagatttgaattttaaagacggctctgtttggtcaaaaacgcctccagagatcaaaccatataaaatcaacgccaaatccatgcaggcaatgccaagcggaagcgatagaaaactggtgaagaaatcagtcaacacacttggcaaatcgcatctagtgactcaaaggtcagcttcaagtccctctgttgaggaaactactcattcaaccctatacaataacaatactcacgcttctactgaaagtgaaatatcaataaagaagagacccactgatgaaagaacagcgcagatacttgaaaatgcaagaaagggtataaacaataggaaaaatcaaccaggcaagagaacaccaagtggtgcagcttctgctgccctagcagcttctgctgctttaaccaagaaaaccatgcaaagctatccaacttctagttcgaaaagtagcaggtcaagctctcctgcgacaacatcaagaccaggaacttataagcgtacttcttctacagaaagtaaaccatttgccaaatctccacctttgtcagcatcagttttatcgtcaaaagtcccaatgcctccatacacacctccaatgtcgccccctatgacaccatatgatacatatcaaatgacacctccctatacgacaaaacagcaggattattctgataccgcaattgccgcacctaagccttgtattagtaagcaaaatgttaaaaatagcacagattctcccttgatgaacaagcaagatattcaatggtccttttacctgaaaaacatcaacgaacatgtactaaggacggaaaaactggattttgttaccacaaattacgatatcttagagaagaaaatgcttaaactaaatggttcattgttagatcctcaactgtttggtaagcctagacatacttttttatcccaagtagctaggagtgggggagaggttacaggttttcgaaatgatccaactatgactgcttattccaaaacagaagatacgtactattcgaaaaatattatcgatttgcagctcttggaagatgattatcgaattgaaggaggtgacttatcggagttgcttactaacagaagcggagaagggtacaaatgcaatcaaaacagctcaccaatgaaagacgatgataaatccgaatctaacaataaaggaagctctgttttttctggcaagattaaaaaattatttcaccctacctcagcagctgaaacgctctcttcctctgatgaaaaaaccaagtactataaacgaaccattgtaatgacatcatttggaaggtttctagtatttgccaagaggaggcagccaaatccagttacaaatttaaagtatgaactagaatatgacataaatttgcgtcaacagggtaccaaaataaaagaactaatcattcccttggaaatgggaactaatcatatagttgtgattcagacaccttacaagtcatttcttttgagcactgataaaaaaaccacgagcaaattgtttactgttctcaaaaaaattcttaattcgaatacaaataaaatagagaaagaactgttgcaaagaaaccaaaaggtaattgaaagaagaacatcatcatccggaagagccatacctaaagatcttccaacttccaagtctccttcgccaaaacccaggacgcatagccaatctccatcaatttcaaagcacaattcgttttctgaatcgattaatagcgctaagagcaacagatcaagcagaatttttgaaacctttatcaatgccaaggaacaaaattcaaaaaaacacgctgctccagtaccgttaaccagtaaattagttaacggattgccaaaaagacaagttaccgtgggattaggtctaaacacaggaacaaatttcaaaaactcatctgcaaaatcgaagaggtcgtaa

SEQ ID NO: 229 - DNA, 4146 bp, Saccharomyces cerevisiae
atggcatctattacttttagaactccattatcctctcaggaacaagccttttataatcagaaatttcaccaattggatacggaagatctcggggtggtcactggcgaggcagtcagaccgctcttcgcgtcttctggtcttccagggcaattactatcgcaagtgtgggctaccgtcgatatagacaataaagggtttttgaacttgaacgagttttcggctgctttgagaatgatcgctcaattgcaaaatgctcccaaccaaccaatttccgctgccctatatgagagcacacctactcaactggcttctttttctataaatcagaacccagcccctatgcaaagcggtagtgcaaccggcaatacaaacaacactgatattcctgccttatcctcaaatgatattgctaaattttcacaactgtttgataggacagcaaagggtgctcaaactgttgctggtgataaagccaaggatatatttttaaaggcaagattaccaaatcaaactttaggtgaaatttgggctctttgtgatagagacgcatccggtgtcttagacaaatctgagtttataatggccatgtatttgatccaactatgtatgtctcatcatcctagtatgaacacaccaccggccgtgttgcctactcagctgtgggattctattcgtttagaacctgttgttgttaatcaaccaaacaggactactcctttgagtgctaactccactggcgtatcttcactaacaagacactctactatatcacgtctatctactggtgcattcagtaatgctgcttcagattggtctttaagttttgaaaaaaaacaacagtttgatgcaatttttgattcattagataagcaacatgctggttcgctaagctctgctgtgttggttccattcttcttatcctctagattaaaccaagagacgttagccaccatctgggacttagctgacatccacaacaatgctgaattcaccaaattggaatttgctattgccatgttcttaattcaaaaaaagaatgctggtgtcgaattaccggatgttatccccaatgaattattacagtcccccgctttaggactttatccgccaaacccacttcctcaacaacaaagtgcacctcaaattgccatcccctcaagagcaagtaagccttctttacaggatatgccacaccaagtttctgccccagcagttaatactcaaccaacagttccacaagttcttcctcaaaactcaaataacggttctttgaatgatttactggctttgaacccttcattcagctctccttctcccactaaagcacaaactgtggttcaaaacaacacaaataatagtttttcatatgataataacaatggccaagcaacattacaacaacaacagccacagcagcctccacctttaactcactcctcctctggattgaagaaatttactcccacctcaaacttcggtcaaagtataatcaaggaagaaccagaggaacaagagcaactaagggaatccagtgatacttttagcgctcagcctccgccagttccaaaacatgcttcaagtccagtcaaacgtacagcttcaacaacactgccacaagttcccaacttttctgtgtttagcatgccagcaggcgctgccactagcgctgccactggtgctgctgtaggcgccgcagtgggtgctgctgctttaggcgcatccgctttttcaagatcttccaataatgcattcaagaaccaggatttatttgcagatggtgaagcttctgctcagttatctaatgctaccacagaaatggctaatttatctaaccaagtaaactccctgtccaagcaggcaagtataactaatgacaaaaagtcaagagcgacccaggagttgaaacgtgttactgagatgaaaaattccattcaaatcaaattgaacaatttacgttctacccatgaccaaaatgttaaacaaacggaacaactggaagcacaagtacttcaagtaaacaaagaaaacgaaacattagcgcaacagttggctgtatccgaagcaaactaccatgccgctgagtccaaactcaatgaactaactactgatttgcaagaatctcaaacaaagaacgcagaattaaaagaacaaattacgaatttgaactcgatgacagcctccttacagtcacaattaaatgaaaaacaacaacaggtcaagcaagaaaggtcaatggtagatgttaattcaaaacagctagagttgaatcaagtcacagtagcaaacttgcagaaggaaatcgatggtcttggcgaaaagataagcgtttacttaactaaacaaaaggagttaaatgactaccaaaagaccgtggaggagcaacacgcacaattacaagctaaataccaggatctgtccaacaaggatactgatttaacggaccgtgaaaaacaattggaagaacgtaacagacaaattgaagaacaagaaaatctctaccatcagcacgtttctaaattgcaagaaatgttcgacgatctatcacagagaaaagcttcttttgaaaaagctgatcaagagttaaaggagagaaacatcgaatacgctaacaatgtgagagagttatccgaaagacaaatgaatttagctatgggacaattacctgaggatgctaaggacattattgcgaaaagcgcctctaatacagatacaacaaccaaagaagccacatcaagaggaaatgttcacgaagacactgtatccaaatttgtcgaaactactgttgagaattcaaacttgaatgttaatcgggttaaagacgatgaagaaaagacagaaagaaccgaaagtgacgtatttgatagagacgttccaactttgggatctcaaagcgatagtgaaaatgccaatacaaacaacggcacccagtcaggaaatgagacagcaaatccaaacttaactgaaacattaagtgataggtttgatggtgatttgaatgaatatggtattccaagaagtcaatccttgacatcgtctgttgcaaacaatgctcctcaatccgtaagagatgatgttgagctaccggaaacgttggaagaacgtgacaccatcaataatactgcgaatagagataatactggaaacttatctcacattcctggtgaatgggaagctaccccagctaccgcttctactgatgttttgagcaacgaaactacagaagttattgaagacggaagtaccacaaaaagggctaattcaaatgaagacggtgagtcggtcagttctatccaagaatctccaaaaatctctgctcaaccaaaagcaaagacaataaatgaagagtttccaccaattcaggaattgcatattgacgaaagcgattcatcctcttcagacgatgatgagtttgaagataccagagaaattccatcagcaacagtgaagacccttcaaactccctataatgcccagcccacatcaagtttggaaatccacacggaacaagtcataaaatatcccgctccaggcacttctccttcacataatgaaggtaactcaaaaaaggcaagcaccaattccattttgcctgttaaggacgaatttgatgatgaattcgcagggttagaacaagcggctgtggaggaagataatggtgctgattcggaatctgaatttgagaatgttgcgaatgctgggtcgatggagcaatttgaaaccatagaccataaggatctcgatgacgaactacaaatgaacgcttttacagggacgttaactagttcctctaacccaactatcccaaaaccacaagtacaacaacagtcaaccagtgaccctgctcaagtaagcaacgatgagtgggacgagatttttgctggatttggtaactccaaagctgaaccaaccaaagtagctaccccaagcattccacaacaaccaattccattgaagaatgatcctatcgttgatgctagcttgtcaaaaggtccaatagttaaccgcggggttgcaactactccaaagtctctagccgtcgaggagttaagtggcatgggatttactgaagaagaagcgcacaatgccttggaaaagtgcaactgggatctagaagccgccactaactttttgttggatagtgcttag

SEQ ID NO: 230 - DNA, 2109 bp, Saccharomyces cerevisiae
atgagtaataaggaagagcatgttgatgagacttccgcaagtggtgtcaaggaggttagttctatagctgctagacatgacaatggttacgcgccttcgctaatcacgtcgacgtcgggcatggactcctttcaatcgcacgcgctactgaatgatccaaccctaatagaggattattcagatatcattaataataggcctacaagtggaagtaaacttactttaggaaacgaggattcggagagtatgggcggaagtgttgtggtgactccgacttcgaataagagttcgcccttcaattcgaaacttaatatactgagtaatgcggcagaaaagggccatgatgttctgcgaaatagagatgatgacaaagagttagaggaggagaacgtggaaaaacatatgcatagcaacagtaaaagggatcagcgacattacaaagaaaattcttcggaattgcccgactcatatgattattcggattctgaatttgaggacaatttggaaagaaggctacaagagatcgaaactgattccgtggatagcgccgataaggatgaggtgcatttttcagtgaataatacaatgaaccctgacgttgacgattttagtgatggcttgaaatacgccatctcggaggacgaggatgaagaggaaaactactctgatgacgatgactttgacagaaaatttcaagattcagggtttcaaggggagaaagacgatttggaggaggaaaacgacgattaccaacccttatcgccgccaagagaactggaccctgataaactatatgctttatatgcgttcaatggccatgattcttcacattgtcaattagggcaagacgaaccttgtatacttttgaatgaccaggatgcctattggtggctggttaagaggatcactgatggtaaaatcgggtttgcgccagcggaaattctagaaacctttccagaaagactagctcgattgaattgctggaaaaatgaaaacatgtcttctcaatcggttgcttcctccgattcgaaagatgattccatcagctctggtaacaagaatcagagtgatgcagagagtataattccgacacctgcactgaatggatatggtaaggggaacaaatctgttagtttcaatgatgttgtcggttatgcagacaggtttatagatgatgcaattgaagatacctcgttagatagtaacgatgatggcggtgaaggcaatggacagtcgtacgacgatgatgttgataacgacaaggaaacaaaagtaacgcaccgggacgaatacactgaagcgaagttaaattttgccaaattccaggatgatgatacgagcgatgtagtgagcgacgtctcctttagtacatctttgaatacaccactaaatgtgaaaaaagttcggagacaagacaacaaaaacgaaagtgagcctaagacatcatcgagtaaagacagagaagatgattataatgcaaatcggtatgtggggcaagaaaagtctgaaccggttgacagtgattacgataccgatctgaaaaaagtatttgaagcgcctcgtatgccatttgcgaatggtatggcaaaatcagactctcaaaattccctttcaacaattggcgagttttcaccgtcgtcgtcagaatggacaaacgaatcaccatccactccaatagttgaagaaagcagcagtattccatcatctagagcaataaggacattcacatatatcatgcaaaatcgaaaattgagagacaacaaacgtggaaaacacagagggcaaattcaagccagcttggggtctagtggaggaatgccaaatcaaactgacgcagaacaacctaaagaggagctagaaaaacatcacagtacccccgaagaagaaaagcaatcaaccttatcgttacactcatcatctgaagaagatttttatatggatgaacaaagggcggtatcatcagcaagcataaatagttcactttccggatcaagggcattgtctaataccaatatgtccgatccggcttcgaagcccaattctttggttcaacatctctatgctccagtttttgacagaatggatgtgttgatgaaaccaattggatga

SEQ ID NO: 231 - DNA, 6156 bp, Saccharomyces cerevisiae
atggacgcttactccacaagaccattaaccctatctcacggttctttagagcacgtgcttctggtaccaaccgcttcatttttcattgcttcgcaattacaagaacaatttaataaaattttgcccgaacccactgaagggtttgctgcagatgacgagcctaccacacctgctgaactagtggggaaattccttggctacgtatcttctctagtcgaaccttccaaggtcggtcaattcgatcaggtcttgaacctttgcttaacagaatttgaaaactgttatttagaaggcaatgacattcacgccttggctgctaaactattacaggaaaacgacacaactttagtgaagactaaagaactaattaaaaattatattaccgccagaataatggctaagagaccatttgacaaaaaatccaactctgctctttttagggccgtcggcgagggtaacgcacaattggtagccattttcggtggtcaaggtaacaccgacgactactttgaagaattgcgtgatctatatcaaacttatcatgtcttagtgggagatttaatcaagttctccgctgaaactttaagtgaactgattagaactactttagatgctgaaaaagtctttactcaaggtttaaacatattggaatggttggagaacccttcaaataccccagacaaggactatttactttccattccaatttcatgccccttaattggtgtcattcaattggctcactacgtagttactgccaagcttttgggtttcactccaggtgagttaagatcttacttaaaaggtgctacaggtcactctcaaggtttggttactgctgtcgccatagctgagacggattcctgggaatccttcttcgtctccgtaagaaaagcaattactgtattattcttcatcggtgttcgttgttacgaagcatacccaaacacttccctaccaccatccatcttggaagattccttggaaaacaatgaaggtgttccatctccaatgttgtccatttccaatctaactcaagaacaagttcaagactatgtaaataagactaactctcatttgccagctggtaaacaagttgaaatttctctagtcaatggtgcgaagaatctagtcgtatcgggcccaccacaatcattatatggtttaaacttgactttaagaaaggccaaggccccatctggactggatcaatcaagaatcccattcagcgaaagaaaattgaagttctccaataggttcttacctgttgcatcaccattccattcccatctattggttccagcttcagatttgattaacaaagacttagtcaaaaacaatgtcagctttaacgctaaagatattcaaatccccgtttacgacacttttgatggttcagatctaagagtcctttcaggttccatttccgagagaatcgtcgactgcatcattagattacctgtcaaatgggaaactactacacaattcaaagccacccacatattagactttggtccaggtggagcttccggtttaggtgttttaacccatcgtaataaagatggtactggtgttcgtgttatcgttgccggtactctcgacattaacccagatgatgattacggattcaagcaagaaatctttgatgttactagtaatggtttgaagaaaaatccaaactggttggaagaataccatccaaaattaattaagaacaaatcaggcaaaatttttgtcgaaacaaaattttctaaattaatcggtagaccacctttattggttcctggtatgacaccatgtactgtttctccagatttcgtagctgctaccacaaatgctggttataccattgagttggccggtggtggttacttttccgcagcaggtatgaccgccgctattgattctgtggtttctcagatagaaaagggtagtaccttcggtatcaacttgatctacgtcaatccatttatgttacaatggggtattccattaatcaaggaactaagaagcaaaggttatccaattcaattcttgaccattggtgctggtgtcccatcattggaagttgctagtgaatacatagagacattaggtttgaagtacttgggtttgaaaccaggttccattgatgctatttcgcaagttataaacattgctaaagcacatccaaacttcccaatagctttacaatggaccggtggtagaggtggtggtcatcattctttcgaagatgcccacactccaatgttacaaatgtactccaagattagaagacatccaaacattatgttgatattcggttctggtttcggttctgctgatgacacttacccatacttaaccggtgaatggtccacaaaattcgattatccaccaatgccattcgatggtttcctatttggttcgagggtcatgattgctaaggaagttaaaacttctcctgatgctaagaagtgtattgctgcttgtactggtgttcctgatgataaatgggaacaaacctacaagaagccaactggtggtattgtcactgttcgctctgaaatgggtgaaccaattcacaaaattgccactcgtggtgttatgctatggaaggaattcgacgaaaccatcttcaacttaccaaagaataagttggtaccaactttggaagcaaagagagattacattatctcaagattgaacgccgatttccaaaaaccatggtttgctaccgtcaacggtcaagcccgtgacctagccacaatgacatacgaagaagttgcaaagagattggtggaattaatgttcatcagatctaccaactcttggtttgatgtcacatggagaacctttactggtgatttcctacgtcgtgtcgaagaacgtttcactaaaagtaagacattgtctttaatccaatcctattctctactagacaagcctgatgaagctattgaaaaagtatttaatgcttatcctgccgctagggaacagttcttgaatgcgcaagatattgatcactttttgagcatgtgtcaaaatccaatgcaaaaaccagtgccttttgttccagttttggatcgtagattcgagatttttttcaaaaaagattcgttatggcaatctgagcacttggaagccgtcgtcgaccaagacgttcaaagaacatgtatcctacatggacctgttgcagcacaattcactaaagtcatcgatgaaccaattaagagcattatggatggtattcacgatggtcacatcaaaaagttactacatcaatattacggtgacgatgagtcaaagattccagcagttgagtactttggtggtgaaagccctgtagacgtacaaagtcaagttgattcttcctctgtatctgaagactcagctgtttttaaggcaacatcctctactgatgaagaaagctggtttaaggctttggcgggatccgaaattaactggagacatgcaagtttcttatgttcctttatcactcaagataaaatgtttgtttctaacccaattagaaaagttttcaagccaagccaaggaatggttgttgagatttccaacggcaatacttcttcaaagactgttgtcactctttcagaacctgttcaaggtgaattgaaaccaactgttattttgaagttgttgaaggagaacataatccaaatggaaatgattgagaacagaactatggatggtaagcccgtcagcttgccattgttgtacaacttcaacccagataatggttttgctccaatctctgaagttatggaggacagaaaccaaagaattaaggaaatgtactggaaattatggattgatgagcctttcaatttggactttgacccaagagatgtcattaagggcaaagatttcgagatcaccgctaaagaagtttatgactttacacacgctgttggaaacaattgtgaagacttcgtttctagacctgatagaacgatgttggccccaatggactttgctattgttgtcggatggagagccatcatcaaggccattttccctaatacggtcgatggtgacttattgaagttggttcatttgtctaacggctacaagatgattcctggcgctaagccactgcaagttggtgatgttgtttcaactactgctgttattgaatctgtcgtcaaccaacctacaggaaagattgtcgatgtggtaggtacattatcgagaaatggcaagcctgtcatggaagtcacctcctcattcttctacagaggcaactatactgactttgaaaacactttccaaaagactgttgaacctgtttatcaaatgcacatcaaaacttctaaagatatagctgtcttgcgctctaaggagtggttccaattggacgatgaagacttcgatctgttaaacaaaactttgactttcgaaactgaaactgaagttactttcaagaatgctaacatcttctcttcagtgaaatgttttggcccaattaaagttgaattgccaaccaaagaaaccgtggagatcggtattgtcgattacgaagccggtgcctctcacggtaaccctgttgttgatttcttgaagagaaacggttccacattggaacaaaaggtcaatctagaaaatcctattccaattgcagtacttgattcgtacactccaagtaccaacgaaccatacgctagagtttctggtgatttgaatccaattcacgtttcacgtcattttgcctcttacgcaaacttgccaggtactatcacgcacggtatgttttcttctgcttccgtccgtgctttgattgaaaactgggctgctgacagtgtttcatccagggtacgtggctacacttgtcaatttgttgacatggttttgcctaacactgctttgaaaacatcgattcaacatgttggtatgatcaatggtagaaaattgataaagtttgaaactagaaatgaagatgacgttgtagttttgactggtgaagccgaaattgaacaacctgttactaccttcgttttcactggtcaaggttcacaagaacaaggtatgggtatggacttatacaaaacttctaaagctgctcaagatgtttggaatagagctgacaaccatttcaaggacacttatggtttctctatcttagacattgtcattaacaacccagttaacttaacaattcacttcggtggtgaaaagggtaagaggatcagagaaaactattctgctatgatctttgagactatcgtggatggaaaattgaagactgaaaaaattttcaaggaaattaatgagcacagtacttcttacacatttagatctgaaaaaggtttattgtctgctactcaatttacacaaccagctttaactttgatggaaaaagctgctttcgaagacttgaaatctaaaggtttgatcccagccgatgctacttttgctggtcactctttaggtgagtatgctgctttggcctctttggctgatgttatgtctatcgaatctttagttgaagttgtgttctacagaggtatgactatgcaagttgctgttccaagagatgagttgggcagatccaactatggtatgattgccattaacccaggtagagtcgctgcatcattctctcaagaagctttgcaatatgttgttgagagagttggtaagagaaccggctggttggttgaaatcgtcaactacaacgttgaaaaccaacaatatgttgcagctggtgatctaagagctttagacaccgttaccaatgttctaaacttcatcaaattacaaaaaattgatattattgaactacaaaagtccttatctttggaagaagttgaaggtcatttgtttgagatcattgacgaagcttccaagaaatctgctgtcaagcctcgcccacttaaattggagagaggttttgcttgtatcccattagttggtatttctgttcctttccattccacctacttgatgaatggtgttaaaccattcaagagtttcttgaagaagaatatcataaaagaaaatgtgaaggttgctagattggccggaaagtacattccaaacttgactgcaaaaccattccaggttactaaggaatatttccaggacgtttatgatttgactggctccgaacctatcaaggaaatcatcgacaactgggaaaagtatgaacaatcctaa

SEQ ID NO: 232 - DNA, 378 bp, Saccharomyces cerevisiae
atggaaaaggatgaggaggatgaagaatctgaagaagcagaggaagagctgctggtgcttgaatctgatgagaaactgaatgatgtgaacgatatggaggcaatgctggtagacgaactcgtatgtgacacgagggacctacttgatgtcgatgaagtaagggaagatgagtcagcacttgaggaagaaaccatactggatgacaaaatggaacttgaagaactaactctacttacggaagaacgtgcagtagatactgctgaagaattcgaagatgatgattgcacgaaaaattgtgcgcgtatcgtcgatatgcatgacagtattaaaagtaataagcggaaactattcttggttgtgaaagacaacatactatga

SEQ ID NO: 233 - DNA, 3648 bp, Saccharomyces cerevisiae
atgacaaagaaatcatttgtgagcagtcctattgttagggactcgacattgctggtaccaaagtcattaatagcaaagccgtacgtattaccgtttttcccgttatacgctacctttgcccaactatatttccagcaatatgatcgttacatcaaaggacctgagtggacttttgtctacttggggacattggtatccttgaacatcctagtcatgttaatgcctgcttggaatgtcaagatcaaggcgaaattcaactacagtactactaaaaatgtcaatgaagctactcacattctcatctacaccactccaaataatggttctgatggtatcgttgaaattcagagagtaactgaagcgggctctttgcagacttttttccaatttcaaaagaaaagattcttgtggcatgaaaatgagcaggtattttcttcaccaaagttccttgttgatgaatccccaaagatcggtgatttccaaaaatgtaagggccattccggtgacctaactcatttgaagagactatatggtgagaatagttttgatattcctattccaacatttatggaattattcaaagagcacgctgttgcgccattgtttgttttccaagttttctgtgttgccttatggctattggatgagttctggtattattctttgtttaacttattcatgattatctccatggaggcagctgcagtatttcaaagattaactgccttgaaggaatttagaactatgggtatcaaaccttataccattaacgtgtttagaaacaaaaaatgggtagcattgcaaaccaatgaattgttacctatggatttagtgtctataacaagaaccgccgaggagagcgcaattccttgcgatttgatcttgctcgatggctccgctattgttaatgaagcaatgctttcaggtgaatctactcccttgttaaaggaatccattaaattacgtcctagtgaagataatttacaactggacggtgttgacaagattgctgtgttacatggtggtacaaaggcattacaagtaacacctcctgaacataaatcggatatccctcctccacctgatggaggtgccttagccatcgtcaccaaaactggctttgaaacatctcagggttctttagttcgagttatgatttactccgctgaacgtgtttccgtcgataataaggaagcgttgatgttcattcttttcttgttgattttcgctgttattgcatcctggtacgtttgggttgagggtacaaaaatgggtagaattcaatccaaattgatcttggactgtatattaattattacatctgttgttcctcctgagttaccaatggaattgaccatggctgtcaacagttctctggccgcccttgccaagttctatgtctattgtactgaaccatttagaattccatttgctggtagaattgatgtttgttgtttcgataaaactggtactttgaccggcgaagatcttgtgtttgaaggtctagctggtatctctgcggactccgaaaacattcgtcacttgtacagcgctgccgaagcaccagaaagtacaattcttgtcattggtgctgctcacgctttagttaaattggaagatggtgatattgttggtgacccaatggaaaaggcgaccttaaaggctgttggttgggctgtcgaaagaaaaaacagtaactatagagagggcaccggaaaattggatattatccgtagatttcaattttcttctgctttaaaaaggtctgcttctattgcttctcacaacgatgccttgtttgctgctgtcaaaggtgcacctgaaacgattcgtgaaaggctttctgacattcccaagaattatgacgaaatctataaatcctttacacgctctggttcaagagttttggctttggcttctaagtcgttgccaaaaatgtctcagtctaaaattgatgatctaaaccgtgatgatgttgaatctgaattaacctttaatgggtttttgattttccattgtcctctgaaggatgacgctattgaaaccattaaaatgttaaatgaatcctcccatcgttctattatgattactggtgataatccattaactgctgttcatgtggctaaagaagttggcatagtttttggcgaaactttaatcttagacagagcaggtaaatctgacgacaatcagttgctgttccgtgatgttgaagagacagtttccatcccatttgatccatcaaaagacacttttgatcattctaaattatttgatagatatgatattgctgttactggatatgctttgaatgccttggaagggcattctcaattaagggatctattacgtcacacctgggtttacgcacgtgtttcaccatcccaaaaggagttcttgctgaatacactaaaggatatgggatatcaaactttaatgtgcggtgatggtactaatgatgttggtgctttgaaacaagctcatgttggtattgcattgttgaatggtaccgaagaaggtttgaaaaaattgggtgaacaacgcagattggaaggtatgaaaatgatgtatataaagcaaactgaatttatggctagatggaatcaaccacagccacctgttcctgaaccgattgcacacttattcccacctggtccaaaaaatcctcattatctgaaagctttagaaagcaaaggtaccgtcattacgccagaaatcagaaaagcagttgaagaagcaaattccaaacctgttgaagtcatcaaaccaaatggactatcggaaaaaaaacctgctgacttagcttctttgttgttgaactctgctggtgatgcccaaggtgatgaagcaccagctctaaagttaggagatgcatcttgcgctgccccttttacctcgaaactggccaatgtttctgctgttactaacattatacgtcaaggccgttgtgctttagttaacacaattcaaatgtacaaaatcttggccttgaattgtttaatcagtgcctactctttgtccatcatttacatggctggtgtcaaatttggtgatggtcaagccactgtctccggtttgttactatcggtttgtttcttgagtatttcccgtggtaaacctttagaaaaactatccaagcaaaggccacagtccggaattttcaatgtttacattatgggatctattttgtctcaatttgccgttcatattgccactttagtttacatcactacagagatttataaattggaacccagagagccacaagttgatcttgaaaaggaatttgctccatcattattgaatacgggtattttcatcattcagttggtacaacaagtctctacatttgctgtcaattatcaaggtgagccattcagagaaaacattaggagtaacaaaggtatgtattatggtttattgggtgtgacaggtttggcacttgcaagtgctactgaatttttacctgagctaaacgaagccatgaagtttgtgccaatgactgatgactttaagattaagttgaccctaacattattgctcgatttctttggtagttggggtgtcgagcattttttcaagtttttcttcatggacgacaaaccatcagacatttctgtgcaacaggtcaagattgcctctaaatga

SEQ ID NO: 234 - DNA, 1659 bp, Saccharomyces cerevisiae
atggaggcacttatcgtatttatagtgctttccgtatccggagcatttgcttacaaatgctcctatgaaaggctctggtttaaagtagggtctttgtttgacattatatcaacttcctcgaagaaaaatgtcattccgttggcaagcaaaatggaagttggctcgaatgaggatgtgtctagtatgggtaatttcataaataaattctacacagagtattctttaccctcacataaggtactgcaatcactgcgagtccttttttcattagcaatgatgacgtatacagtaaccatagagattattctatggcagattaaggttgctggaatggacaaggaagttactttcataacgacttgggtgtggcctctgactgcaatcatgctatccttcatactaattttatttcagccctttttcattataatatcgttactgaataaattctacaatgacaagttcgatatcgataggttgataatagtgacatgcataatcttgtccacacttattgcgctgttaagttacataaatattggaccgttccagtacacaaaaaatattctaactagattgtccatcggaggcgtcacagtcatggcttccctatctgggttagccactgtttctagtttatactacaactttttagtcatctggcacaagtttcgtaatacaccaatgtcagaccccagttttagaaacatcaacaacagcaacaataacagtaaatctctcttatggacaacagacgcctatatagaggaaaaaatccaagattatgaacacaacattgaacaaaatgtacaaatattaagaagtttagaagaagaggtcggagaaaactcaacttttaaagcagagttgatggaaaaaatcgcctggtatcaactggagcttgggaaattggaagcattattacaacagtcccctcaggtacgcacttttaagaaagcttttgaagtcgggtttatcatatactgtcttcataaactaataataactttcctgaaaagaatcccctatatcatataccactcgctcaaatatccagatgactacgattatgaaaattttagtgaaaatgcagcatccgatcctttagccattacgatagcaaatattttggatttttcgtttttcaggttcaattaccagcacgatctcgattcgttaacaaaacagatatcgttatttttgtcaatttctctctttctttgctgtctttctgctgtcaataccaccatctcctacgttgtgacccttttgcccataaagttccagattcttgcacttttcgccatgcagaatgatgacactgctaatgtacttccagagtacaccaataactcttcctataagggaaaaaagagaaactattctcaggaacaaaaaggaatatctttgataaaaaatctggtggtgtcagagttgactggcgtctacgttttggctacaacgctaatggttaggtcccatctcccttttgaagtatcacaaagattaaaggagctattgggtggaaagtttaccgtcccaaacattgtcatagattcttggtttgatgaagtctacgcttttgcatgtgtgtttacctttatttgcataagaattgcagaacgaaagctttccaccaaaaaagtcagtgttgaataa

SEQ ID NO: 235 - DNA, 2121 bp, Saccharomyces cerevisiae
atgattcaaaaaatgagcccaagcttaaggaggccatcaacgaggtctagttctggttcaagtaatatcccacaatcgccctctgtacgatcaacttcatcgttttctaatctgacaagaaactccatacggagcacctctaattcgggttctcagtcgatttctgcatcttccactagaagtaactccccactaagatccgtatcagccaaatccgatcccttccttcacccaggtaggataaggatcaggcggagcgacagtattaacaacaactcgagaaaaaacgatacatatactgggtcaatcactgtgaccatccggccgaaaccacggagcgttggaacttcccgtgaccatgtggggctaaaatcgcccaggtactctcaaccaagatccaactcacatcacggtagcaatacatttgttagagacccctggtttattactaatgacaaaacaatagtgcatgaagaaattggagagttcaagttcgatcatgtttttgcttcccattgcactaatttggaagtttatgaaagaaccagtaaaccaatgattgataagttattgatggggtttaatgccaccatatttgcgtacggtatgaccgggtcaggtaaaacgtttacaatgagcggaaatgaacaagagctaggcctaattcctttatctgtgtcgtatttatttaccaatatcatggaacaatcaatgaatggcgataaaaagttcgacgttataatatcgtacctcgaaatttacaatgaaaggatttacgacctgttagaaagcggattagaagaatccggtagtagaatcagtactccttcaaggttatatatgagcaagagcaacagcaatggattgggcgtagaattaaaaatcagagatgactctcagtatggggtcaaagttatcggtctcaccgaaagaagatgtgaaagtagtgaagaattattgaggtggattgcagttggtgacaaaagtaggaaaattggcgaaactgactacaatgcaagaagctcacgatctcatgccattgtactgattcgtttaacaagtactaacgtaaagaacggcacctcaagatcgagtacattgtcgttgtgtgacctagcaggttcggaaagggctacggggcaacaagagaggagaaaggaaggttcattcatcaacaaatccttacttgctttggggactgtgatatccaaactcagtgccgacaagatgaactcagtaggctcaaacattccctcgccatctgcaagtggcagtagcagcagtagtggaaatgctaccaataacggcactagcccaagcaaccacattccatatcgtgattctaaattgactagattattgcagccggcactaagcggtgacagcatagtgacaacgatatgtacagtcgacaccagaaatgatgcggcagcggaaactatgaatacgctgaggtttgcatcaagagcgaaaaacgtcgcacttcatgtatccaaaaaatccatcatcagtaacgggaataacgatggagataaagatcgcaccattgagctactgagacgccaattggaagaacaacgtaggatgatctctgaattgaagaaccgttcaaacattggcgagcccttaaccaaatcttccaatgaaagtacttataaagacattaaagccaccggcaatgatggtgatccgaatttggctctaatgagagcggagaatcgagtattaaaatataaactagagaattgtgaaaaactactagataaagatgtggttgatttgcaagattctgagattatggaaattgtagaaatgcttccctttgaggtcggcacccttttggaaacaaagttccaaggtttggaatcacaaataaggcaatataggaaatacactcaaaaacttgaagacaagatcatggcgctagaaaaaagtggtcatactgcaatgtcgctaactgggtgtgacggcactgaagtgatcgaattacagaagatgctcgagaggaaggataaaatgattgaggccctgcagagtgccaaacgactgcgggatagggctttgaaaccactcattaatacacagcaatcaccgcaccctgtcgtggataacgataaatga

SEQ ID NO: 236 - DNA, 1137 bp, Saccharomyces cerevisiae
atgacaattaacacaaagaacatagttgttgttggtgctggtgtgtttggtgtgtctgtggcaaatcacttgtacagggaactgggtgggacatacgcaataaagctcgtcacagcatctaattatgtgtattttctaccctcagctgtccgtttgacggtttcaaaggattataccaagtcgatcctgccgttaaaaaatgttcttgatagtggtattgaagttatcaaagatacggctgccagctttgatgataaggaggtagttttggggtcagacagggccataaagtttgatatcttggttcttgcaactggctcaaagtgggctgatccaattggttcaacttataccttcggggataactataaagagtattttgaaagagaggcttctcgaatctcagatgcagatcacatactttttcttggcggtggctttgttaattgtgaactagctggtgaattgttattcaagtatttggaggagatcaggtctggcaaaaagcgtatttccattattcataattccgataagctactgccggactctgggttatacaacgataccctaagaaaaaatgtgacagactatctctcaaaaaatggtattacgttgtacttgaacacagtaggggcttctttagacacctcgccgaaacgtatttttctaggtgagggctcatctaaatatatagatgctgatttgatttacagaggcgttggtatttctccaaatgtgccggtcaacagtatttcagacctttgtgacaagaaagggttcattcaagttgaaaaaaacttcagggtaaaagctgttgaggcaggaaacgtttttgccattggtgatgtaacgaattttagatatcacggattggttaaaagagataattgggttgatgttttgacccgaaatgttataagttctttacaagaaggaacagaggctagtctcgttgatgcagattgtcttgagacaggacatgccccaagtggtgtctcccttgggccaaatgcagggtttggccaatttccactaccgttacttgggacgattaatattccatcgtttttaatttctagagcaaagtcgaagaatcttttctccgacaaaatggaacctttattcaaaaaatag

SEQ ID NO: 237 - DNA, 1047 bp, Saccharomyces cerevisiae
atgtctattccagaaactcaaaaagccattatcttctacgaatccaacggcaagttggagcataaggatatcccagttccaaagccaaagcccaacgaattgttaatcaacgtcaagtactctggtgtctgccacaccgatttgcacgcttggcatggtgactggccattgccaactaagttaccattagttggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaagaatacgctaccgctgacgctgttcaagccgctcacattcctcaaggtactgacttggctgaagtcgcgccaatcttgtgtgctggtatcaccgtatacaaggctttgaagtctgccaacttgagagcaggccactgggcggccatttctggtgctgctggtggtctaggttctttggctgttcaatatgctaaggcgatgggttacagagtcttaggtattgatggtggtccaggaaaggaagaattgtttacctcgctcggtggtgaagtattcatcgacttcaccaaagagaaggacattgttagcgcagtcgttaaggctaccaacggcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataa

SEQ ID NO: 238 - DNA, 1692 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 239 - DNA, 462 bp, Saccharomyces cerevisiae
atgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatga

SEQ ID NO: 240 - DNA, 858 bp, Saccharomyces cerevisiae
atgtgggctcaattatcatatactagaccagaatctcagaagactgacttaacgtcgttgttttccacagatcaagagcaaaatccattaaatgactaccagtaccagatcaatattagggaactggaggagtattacaacaagacgattttaaacgaggataacatacaggaaacaagcagtgaaatatcttcggcagtttcattctctccaccaaaaaatacaaacgctattcaaccggggctactgtatgatccacagttaatgaacccttttctcccatccgctcacctgaatagcacggcacctactacttttaaaaagaaactagaggtacaaataaatccggactatgtcccaaaatcttcacaattaccattaacttcacagaatttgcaacagttgtctcaacaaaagcccaaaaatgatgcttctttttcatcagagaaggaatcctcagctcaacctaaggtgaaaagccaagtgcaggaaactcccaaacaattatacaagacagagctgtgcgaatcattcactttaaaaggaagttgcccttatggcagtaagtgtcagtttgctcacggactcggcgaattaaaggttaagaaatcgtgcaagaatttcaggacgaagccctgtgtgaattgggagaaactaggttattgtccttatggcagaagatgctgcttcaaacatggcgacgacaacgacattgctgtttacgtgaaagctggtacttactgtaacgtctcttcgactagcaaacaatcagacgaaaagagaagcaatggtcgcggctccgccaagaagaagaatctaaatgttaaagtaaaggctttgcagagaatgacctggtga

SEQ ID NO: 241 - DNA, 4263 bp, Saccharomyces cerevisiae
atgagttctgacgcttccacgtacagacttgaggatgttttatccagcttctatagagtggagaaaatcaaaaagatcaactatcatcagtacatttctaaagcccaaaacgatcaatggtctatccaaatggaattcatgctacggaagcaggatccaaagactctagttgcgctgctttcaagggatttatggtgtttcagtataaatgatgatccggtaccgacacctcctgcgatagaacataaaccagtgagcccagataaaatcggaactttcactgccgattattcaaagccaaacttaccgccacactatgctctttttttaaaagctttaagaaggaaaatttacattaatttggcattaggttcacacaataagctaatacaatttgggaatgcctgcatatcattaagcggagtgccaaattatctcgtacagctagaaccacacctttttgtaaacggagatctcacagtgtcgttatgtgccaagaacatgggattagtaccaatgaaggaggaaaatttggaagaatctttcctttcaaagcatgcgctttatttagcaccatctggaataaggatgcatttggcccctgcttccaagcaaggatacttgataacgccaccaaaacatacagaacttctcttgacgacgttaagtgtatctcatggtataaacttacaaaataaaaaaaatttgaaatgggttgctgttgttcctgacttaggacatctcaacggccacacacctactatagcttcgtatttaactcccttacttgaagcaaagaagctagtatggccgctgcatttaatcttcgcccaaccagtagctgatatagaaaattctacttccggagatccatcagaatttcactgtttgcaagatgctctggatgccattgatgatttcatacaattaaagcaaacagctgcctataggactccaggaagttccggcgtattgagcagtaatattgctggtacaaatcccttaagctcagatggagcatatacagaacagtttcaacattataagaacaactcaattagttctcaacccgcttcttatcattctgtccaagaaactaataagatatctccgaaagatttctcccctaatttcacaggcattgataaattaatgctgtcgcccagcgatcaatttgctccagctttcttaaatacccctaataataacatcaatgagaatgaattatttaatgataggaaacaaactacagtatcaaatgacttagagaacagcccactgaaaacggaactggaggcaaatggtagatcactcgaaaaggtaaataattccgtgagcaagacaggaagcgtagacacacttcataataaagagggaacactggaacaacgagaacagaacgaaaatctgccaagtgataaaagtgactctatggtagacaaggaattgtttggtgaggatgaggatgaggatttatttggcgatagcaataaatcgaattctacaaacgaatcgaacaaaagtatatcggacgaaattaccgaggatatgttcgaaatgtctgatgaagaagaaaataataacaataaaagcattaataaaaataacaaggaaatgcatactgatcttggtaaagatattccattttttccctcatctgaaaaaccgaatatccgtacgatgagcggaactacaaaaagattaaatggaaagaggaaatatttggatattccgatagatgaaatgaccttgccaacgagtccattatatatggacccaggtgcgccactccctgtggaaacaccccgcgatagacgcaaaagtgtgttcgctccactgaattttaaccccataatagaaaacaatgttgataacaaatacaaatctggagggaaattttccttcagtccgttgcaaaaggaggaagcattaaactttgatatttctatggcggatctttctagctctgaagaggaagaggatgaagaagagaacggtagcagcgatgaggatctaaagtcattgaacgtacgcgacgacatgaaaccttctgataacatcagtactaatactaatattcatgagcctcaatacataaattactcttcgatcccaagtctacaagactctattataaagcaagaaaatttcaattcagtaaacgatgctaatatcactagcaataaggaaggcttcaactctatttggaaaattcctcaaaatgatataccacagaccgagtcaccactgaagaccgttgattcatctattcaacccatagaatccaatataaagatgaccttggaagataataatgttaccagtaatccgtccgaatttacgccgaatatggtaaattctgaaatttctaacctaccaaaagacaagagtggtatccccgaattcacaccggcggaccccaatttatcttttgaatcatcaagtagtctaccgtttctattgagacacatgccgctagcatctataccggacattttcatcacgcctactcccgttgttacaatttcagaaaaagaacaagacatcttagatttaattgcagaacaagtcgtcactgattataatatcttaggaaacctcggtattccaaagatcgcctataggggagttaaagattgccaagaaggtttaataacaaccacaatgttacagttattttccactttcgatagattaaatggcaatgatacgatctccaaattctataacatgaagcagccgtacgtttttgtaaagaaacatcacgaactaatcaaagtcaaacacgactctcagccatttattaagttcctcaattttcgccctccaaatggaataaaaaacttcaaatccttattattaagttcatctttcaaagaagattgtctgtcatttgcgccaactctatctcaaacatatattaatcaagagttagggttttgtgagttgcttaaactaactaatgaagacccgcccggactgatgtacttgaaggcatttgataaaaacaagttactgttgttagctgcgcagattgtttcatactgttctaataataagaactccatcaaaaacgtgccaccaatattaataattttacccttggataatgcaactctgactgaattagtagacaaggcgaatatttttcaggtgatcaagaacgaagtttgtgccaagatgcctaacattgaactatatttgaaagttattcctatggatttcattagaaacgtactggtgacagtggatcagtacgtcaacgtagcaatttctatatataacatgctgccgccaaaatctgtaaagttcacccacattgcgcatacgctgccggagaaagtgaatttcagaaccatgcagcaacagcaaatgcaacagcaacagcaacagcaacagcagcagcagaataacagtacaggatcatcttctataatatattatgactcgtacatccacctggcatactcgcgtagtgtagataaagagtgggtttttgcagctctttcagatagctatggacaaggcagcatgacgaaaacgtggtacgtcgggaattccagaggaaaatttgacgacgcatgtaatcaaatatggaatatcgccctaaatttagcgtctaaaaaattcggaaaaatatgtctaattttaactagattgaatggcatactgccggatgatgaattgatgaattggaggagactttctggtaggaatatacatcttgctgtggtgtgtgtggatgacaactctaaaatctccttcatagatgaggacaaattgtaccctagtttcaagccgatctacaaagacactaggtttggaggacgcatggatatgaccagattatacgactatgaaataagggatatagaccaggacatccatggaatagtatttcagcacccgttcccactggcacactcacagcatcgctgtgctattaggagtggtgctttgatcaaattcaaaaaatgcgacggtgatacggtttgggacaaattcgcagtcaaccttttaaactgtccacattctgatagtacacaattgctggaaaccatcttagaagagtttcgcaacctggctgctctaaacgtgtggtacggtctctctgatggcgaagatggccatattccatggcatatcctagccgtgaaaaaaatgatgaacactcttgtgcacaccagagtaaaaattgctaatacttccgccgctactgtgcataccgctacttcttcatcaattattctctcggataaataa

SEQ ID NO: 242 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 243 - DNA, 1425 bp, Saccharomyces cerevisiae
atgagtatttcaaattggatcaccactgcgtatttaattacatcaacatcttttcaacctctttatgggtcattttctgatgcacttggtcgaagaaactgccttttctttgctaatggggcttttaccattggatgtctagcctgtggtttctcgaaaaacatctacatgcttagttttatgagagcattgacaggcataggaggtggtggcttgatcacactttctacaatcgtaaattcagacgttattccaagttcgaaaagaggaatttttcaagcgtttcagaatttacttttgggatttggtgccatatgtggagcgtctttcggtggcacaatagcgtcgagcattggttggaggtggtgttttctcatccaagtacccatatctgtgattagttccatattaatgaattattatgtacctaatcagaaagaatataatcgtcaaaattctagcatattccaaaatcccggaaaaatactcagggacatagatgttatgggctcaattcttattataactggtctcacactacagcttctttacctgagcctggggtgttctacttctaaattatcatggaccagcccttctgtgctactgctattagttgggagtgtaataatcctcttactgttcatattgcacgaaaggaaaacaagtgctagagcgattattcctatggagctggtcaattcctcctacagtgtcgttgtactttcgataagtatacttgttggttttgccagctacgcgtatctttttactttaccattattctttcagattgtacttggagattccactgcaaaagcaggattacgtcttacgattccttccctatttactccggtaggcagtctcataacaggattttccatgagcaagtacaactgtctaagattattactctacattggtatttctttgatgtttttgggtaactttttattcctgtttattgaaaaaacttctccgaactggttgattggtctatttttgatacctgcaaatctaggacaaggtatcacttttcctacgaccttgtttactttcatatttatgttctctaagagtgaccaagctactgcgacatcaactttatatttattccgtagtattggatctgtatggggtgttgcaatttcagctggcgtcattcaattatctttcgcaggtttattgcgtagtaatttgaaaggtctactggatgaaaacaagataaagaaacttattgttcagcttagtgcaaactcctcatatattggatctttacatggcgaagttaaaaacacagtcataaagagttttgatgaggcaacaaagagggctcatctaatgtctacattactctcttcattggccctgatactctgcatccttaaagacaatctggcgaaacctaaaacaagaagataa

SEQ ID NO: 244 - DNA, 243 bp, Saccharomyces cerevisiae
atgatcactatgaagatgttcttgtttttaaacgaggcatgcatctttatagattctgtatgcgaaggtattgttttctggggcctttgtctattcgtatgcgccgaatgtgagaatgccagttataggggtgccgaggtgccttataaaacccttttccgttcctgtgatacttccatttttggtgtagcagaatgtctgaatttagttgctatagatcctcgttcagaagcgtattgctaa

SEQ ID NO: 245 - DNA, 483 bp, Saccharomyces cerevisiae
atgtctataccccattccgtattttcggcactcttggtcttcgtggcgctagctactacaaccttagccagtacagaagcttgcttaccaacaaacaaaagggaagatggtatgaatattaatttttatgagtacacaataggcgaccaaaccacatacttggagcctgaatatatgggctatgaatactccaatacaaagaagttaggttccgttagcggacagaccaatctctccatatactatagtccgccttgtgagagcactcctacctgtgtgacttatgcagttttgaagcgtgatgaggatggatatgatccttgcggacctctttatgaaactaaaaaacgtgacactgaatactgtgacccaaatactgcctattggagttctgatctttttggtttctatactactccaactaatgtaactgtggaaatgacagggtacttaatatggagtatgggcaaccgacgccgttga

SEQ ID NO: 246 - DNA, 2424 bp, Saccharomyces cerevisiae
atggttttggaagtgccctcaatcacacctggtgaactgcatgatcttatgcgactacatcaggatgcagaatggcctgaatgtaaaaaaatgttcccctgggctcatgatatttcctttggtcaaccacccgattttcctcattctcttgcaatagtcaaatcgcaatcagatgctaacaattctgcgcttttgcgtaattctctcgaagtgaatgatatcttccagtcctggaaagttcgcacttcctttcatagagagggcgatacctgtgaaactggaaatgattctaatggttttcaatatcccaataacacaaaggaacttttgaacttgctaaagtttcagatacgacaattggaattgcaagtggatgatgttgctttggaaaacgctgctacttattgtcacaatcatagcattttaccatttctgaaagtagatcctcgtggactatcattagaacttaaaaggtattctagaaacaaggttgggtctaataccacgctaaaacggagtgggcaggacgtctggggaaggagaggtctattccgaaggttcgacctgcaatgtgccaagatgatagaaatggttgataatatagtaatttattgttcgcggactggtggcagcactgatatgcaaacagaatcagcgccagcgtgctcacacgagggaaattgccccaattgtacaacccttgcactacttttacagatctgtttaatgtttgttcaaaagggttatgtagggagtggaggatcgctttacaagacgaatctttttatttgcacttatcagaatttcaatacagatatacctcaaactttgattggtacacctttattagacaacgaatttttcaagaataatactcccttgaatttatgttcgtcacctagtgaaatagtgtgtttcaataacgttgataagaatatggttttgtgcgagaagttagagttgaataagctgacttcagctacacgattggaggaaacagggttgatttgcggtaacaccactgattggcataattatcaaataattaaaaaaaacaatatatctctgacccaccgtttcgaagagaatacaagcatagtaaatttaaagtctctaaattatgatacggacaatccgacaacctccatttctcaactgtataacataccgaatacaaaagaggtgtggaaattgatcataaaatgtacgtcaaactcgcaaatgccgtcgttaacgaaaatccgaacatatctagatcttttattagacgatgatgcgtcaaaatcacaagagcatttgcatttgactttccctgcctcaggtagtataggtttggggaacttaaacattcagtctgtggaaattcttttgaatgtttgttatttaatatttcaagtatcccaagttcaagaattattgacgttcatgtattgcgaagacggatatacagaaacgtcattattattaacagcttatattatattccactttaatattccgttacaagacgctcttttgaggatccatccaagaccatttttcctttttccatcagacttgcaaattttaggccatttacaacctgtcctgcgggagtttagtccgcagaatggaagtaatctaaaattatatgccaatgcattgaaatttagggataaaagctttcaattacacatttcttcagagctttttagtagcatattttttatgaagattcctcttgagtctaatttcgttaatttgaagggcccactgccatcccggattctacgtcacttgtatttgggatccctggatcatgcacaaaatcctgccttacttaagtctctaggaattacgcatatagtttctgtcggtgaagttgtttcatggacattgaataaggataaaattgctcatcctgtaaggccacatcgtgcaataactatgacgaataccaatgaagttgcaggtaatactacatgtaataaaagcagaaatagagctgatactgtggtcagcgataagcaagaaaatggcagcaacgtagtaataagtgaaaattctggatttcaaatttgccagatcgaaaatctagatgacaacggcaaagatccgcttttccaccaaatagacaaagttttggattttattagcaattccgaagcaacaggagggaaagttctggtgcattgtatggtcggagtctccagatctgcaacagtttgtatagctgaatgtatgagatatctccagtgtgacctggcaagtgcgtatttgtttgtgagggtacggaggcttaatgttatcattcaaccaaacttgttcttcgtatatgagctcttcaaatggtggaaaaagcattataatcgcgaaaaagacaaaactatggattggcacatcatctgtaggggtatcgctgaggttaatatgaagtacacatga

SEQ ID NO: 247 - DNA, 1668 bp, Saccharomyces cerevisiae
atgtcggatgtagataactgggaacccgtatcagataatgaggacagtactgattctgtgaaacaattgggtcccccctttgagcatgcaagtaacaatgacaatgccggcgatactgaagctgagtcactgcaagaagtgcccctaaatacagagaccaacgacgtacgcaagaatttagtagtgattacaaaccaaagtgccgccgatgaacaccctacagagatcaagcacgatcaatcaaggacttcttcgacgtcctcgttcttcagtggaatgatctcttcgtttaagtcaaacgtgccatccccagtttctagatcaactacgccaacttcgccagtttcgcaaccaagcattatatcacatagaagggagccttccatggggtccaaaagaagatcaagccgccgtatcagtaatgccacaattgctgaaataggctctcccttgcaacaggtggaaaagcctgatgaggtcaagacaagactcactccttcccaaatgaaagaagacaattacgatcatagacgattcgtggaagaacgttacatggacacaccttatcactatgcgtctgagcaaagaaataaagactttcatgagacattcaagtccgttcctaaagatgacagactactggatgattttaattgtgggctgaatagagagctgctttaccaggggaaactatacataacagaaacgcatctctgcttcaactccaatgttcttggttggattgctaaagtactgattgcgttcgaagatgtcacgtttatggaaaaaacttctgctgctgggttgttccccagcgcaatatccatcgaaacaaagatgggcaaaactctctttaatggttttatatccagggatgctgcatttggattaatgaaagaagtgtggtcaagaaccttgttgcagaaggacatggccagcgaaaacatcaatactaaagcagaaaagtcaggaaatggcaaagagattgatgatgcaataaactccatcgatgaggaaaacaatgataaagacgctaatgataatgacactaatgaaaatgacgatgaaaatatctctacaaatgagactacccccaatagtacgagttcctcgccggataaagaaaaagagaaagcgtataaactgcgtgccgattcctcgtatcagtatgatggtccaatatatcatcattcaacaagctttccggctgaacctatggccaataacgagtttgttctcaaggagttaccattcgattgtgcacctggtatactttttgagatcatgttcaactcagagcaaaacgaatttcttctagattttttacggggtcaagaaggttcacaaattaccactattccaaatttcacgagcattgacggatcttccatgactttgaagcgtgagtattcatacgagaaagcattgcactttcctgcggggcccaagtccacgacatgttatgttgctgaggtaataaagagaaaagatcctgatacttactatgaggttatcagtagcatacgcactccgaacgtgcccagtggtggtagtttctcaactaagacaaggtatctaatccgttggaatgacggaaataacgtgtctgttacgggtatccttttgggtggaatggactggttccagttggatcaaaggtatggttga

SEQ ID NO: 248 - DNA, 1956 bp, Saccharomyces cerevisiae
atggcaaagaagaataagaaggataaagaggccaaaaaggcacgtgctgaactgaagaatcagaaaaaccaaaaaaagcaggagaaaaagtttcagaagaacaagaataagtctttaaacggcgaagaagatgatgaaagtgatcaagatctcgatgaaattctctctagctttagcaaaaagcaaattgaattagagcatgtagacatcacttctgtggaaaaaccctcttgtcgtactcatccgttgatgtttgcaaatccgcaacacaataaacatgaattgttcattttcggtggtgaatttacagatccagaaaccaaactaacacatttctataatgatttgtattcatactccataaagaacaactcttggaaaaaatacgtttcgcaaaatgcacctttgcccagatccagtgccgctgtcgctgtgcatccttccggaatagcactgttacacggtggtgaattttcgtccccaaaacaatctaaattctaccactattctgatacatggctgtttgactgcgttgaaaggaaattcactaagttggagtttggcggtagagactcttcacccagcgccagatcaggtcatagaattattgcttggaaaaactatttcatattatttggtggatttagagatttggggaatggtcaaacttcttacctaaatgatttgtggtgttttgatatctcaacctacaaatggaccaaattggagacaaacagcaaacctgacgctagatcgggtcattgtttcattcctacagataattctgccatattaatgggtggttactgtaaaatcattgccaaaaataataaaaatttaatgaagggaaaaatcttgaatgatgcatggaaactgaacttaacgcctgatccaaagaagtggcagtgggaaaaattaaagaatttcaagaaccagccctcaccaagagtcgggtattcgttcaatctatggaagcaaaacaagtccgttgcttttggtggtgtctacgatttacaagagacagaggaatccttagagtccgttttctataacgacctatatatgttccacctagagttgaacaaatggtctaaacttagaattaaacctcagcgtcaaacgaatagtaaaaattcacccgccacaagtaaaagaaaatctaataaagatcaagaaaaggaactgcaggatttactaaattccattctggccaagtctaatctaaatgacgacgacgatgacaatgatgacaacagcacaacgggtcctaactctatcgatgacgacgaagataacgaagatgacagtgatttggacaaccaagaagatattaccatctcaaatcaattacctcacccaagatttaacgcagcaacttgtgtagtgggcgactcgttgttcatttacagtggtgtctgggaactgggcgaaaaagattatcctataaactcattttatagtatagatttgaacaagttggatggtgtcaaggtttactgggaagacctatctgccatcgaagaagcaaagagactaggtgatagagattcggacgaagatgagtttgaatacgaggacgatgaggaggatgaggacgacggcgaagaggaacaagatgcaggaccccttgaaggtgatgaagatgaggaaagcgagagcgacgatgacaaacaagcgcagatggagattccagacgaaaggtcttggctaccacacccaaaaccgttcgaaactttaagagcattctacttaagggaaggtgcaaatttcttaacctggtctatttctaacaacagaaaccttaagggtaaacagttaaagacgaagtcatttgagttatgtgaagaccgttggtgggaaagaagagatcaggtgacccttgaggaagagcgtctggaggatacaggcggaatcattgaaagagatacgactactaaaccttccaaaagaaggtaa

SEQ ID NO: 249 - DNA, 2088 bp, Saccharomyces cerevisiae
atgattgtaagaatgatacgtctttgtaaaggtccaaagttgttgcgaagtcaattcgcatcagcaagtgcactatattcaaccaagtcattgttcaaacctcccatgtaccaaaaagcggaaattaatttgattattccacatagaaagcactttttgttgcggtcgattcgattacaatcagacattgcgcaaggaaagaagtccaccaagcccactttaaagttgtccaatgcaaattcaaaatcctcggggtttaaagacattaaacggctattcgtcttatctaaaccggaatccaagtacattggtcttgccctccttttaatcctcatttcaagttcagttagtatggctgtaccttccgttatcggtaaattattagacttggcttccgaaagtgacggcgaagatgaagagggctcaaaaagcaataagttatatggttttacgaagaagcaatttttcacagcattaggagcagtatttataattggagcagttgctaatgcaagcagaatcatcattttaaaggtcaccggtgagagactggtcgcaagattaagaacgagaacaatgaaagctgcattagatcaagatgccacatttttagatactaatcgtgtcggtgatttgatctcaagattatcatctgatgcatctatagtggccaaatcggtcacacaaaacgtctctgatggaacaagggcaattattcaagggtttgtcggttttggcatgatgagcttcctctcgtggaaattgacttgcgtaatgatgattttagcccctcctttaggtgctatggcactgatatatggtaggaaaatacgaaacctatcaagacagttacaaacctcagtaggtgggttaacaaaagtggcagaagagcaattaaatgctactaggacaattcaagcatatggtggtgaaaaaaacgaggttcgccgctatgcaaaagaggttagaaatgtatttcatattggtctgaaggaagcggttacttccggtttattcttcggaagtactgggctagttggcaacactgcaatgctgtcgttattattggttggaacaagcatgattcaaagtggttcaatgactgtcggtgaattatctagtttcatgatgtatgccgtgtataccggaagttcattatttggtttatcgagcttctattcagaacttatgaaaggtgctggtgcggctgccagggtttttgaattaaatgaccgtaagccattgattcgtccgactattggaaaggatcctgtgtcattagcccaaaaacccatcgttttcaaaaacgtgtcattcacttatcccactcggcccaaacaccagattttcaaggatttgaatattactatcaagcctggtgaacacgtttgcgctgtcggtccatcaggaagcggcaaatcaacaattgcgtctttgttgctcaggtactacgatgtgaactcaggatcgatcgaatttggtgatgaagacatcagaaatttcaacttgaggaagtatcgaagactaataggatacgtgcaacaagaaccactacttttcaatgggactattctggacaatatcctctactgcattccgcctgaaattgcggagcaggatgatcgtattagacgtgctattggaaaagctaattgcacaaaatttttggccaattttccagatggattgcagactatggttggtgctagaggcgcgcaattgtccggtggtcaaaagcaaagaattgcattagctagagcgtttttactagatcctgccgtccttattttagatgaagcaaccagtgcccttgactctcaaagtgaagaaatagttgccaaaaatcttcagagacgtgtggaaagggggttcactactatatcaattgcacataggctttcgacgatcaaacacagtactagggtgattgtgttaggaaaacatggctcagtggttgaaaccggttcattccgagatctaatcgccattcctaatagtgaactaaatgcgctgcttgccgaacagcaggacgaggaaggaaaagggggagtgatagatttggacaatagtgttgcccgggaagtataa

SEQ ID NO: 250 - DNA, 2709 bp, Saccharomyces cerevisiae
atggagcaaatcaattcgaacagtagaaaaaagaagcaacaattggaagtattcaaatattttgcaagtgtccttacaaaagaggacaagcctattagtatcagtaatggtatgttagatatgccgacagtgaactccagtaaactcacagcaggaaatgggaaacctgacacggagaagcttacaggagaactaattttaacatacgacgatttcattgaactgatatctagctcaaagactatttattcgaagtttacggaccattcgttcaatttgaaccagatacccaagaacgttttcgggtgtattttcttcgctattgatgaacaaaacaagggatatctgacgcttaatgattggttttattttaataatttattagaatatgataattatcatctcattattctatatgagttctttaggaaatttgatgtagagaatttgaaggcaaaacaaaaaaaagagcttggtagttcgtcgtttaatttaaaggctgcagatgatcgaattaagtcaattaattatggtaacagatttctaagctttgatgatcttcttttgaatctgaaccaattcaaagatactatccgcctgttgcacgaatctattgatgataattttgttaaagataacaaattactacttgattggaatgactttcgatttctgaaattttacaaatgttatcatgaaaatgaagagtatttgagtttaaactctctggtcacgattttacaaaatgatcttaagaatgaaaaaatatttataggttttgataggttggcacagatggactcacaagggcatcgtttagccctaagcaaaaatcaactcacctatcttctaaggttattttactctcacagggtgtctgcagatatattttcctccttgaatctatcaaacaccgaattactaaaagcggacaataattccattccgtacaatgtattcaaggatatattttatttatttcaaaattttgacctactgaaccaaatatttcacaagtatgttactgaaaataatttgaatgagcaggatattagggaacaaatagttactaaaaatgactttatgacagttttaaacgcccagtataacaaagtaaacaatatcattgagttctctccttcccaaatcaacctactattttctatcgtcgcaaattcaaaggaaaacagaagattaagaaagagaaatcaagatcgagatgacgagctattaaatgatcaccattatgattcagatattgatttttttatccataatgagtatttgcatggagtaagcagatccagaaaaaatttagaaagttttaatgactattatcatgatctctcggatggatttgaccaagactctggtgttaaaaaagcttcaaaagcgagtactggcttgtttgaatctgtatttggaggtaaaaaagataaagcaacgatgcgttctgacttaacaattgaagatttcatgaaaattttgaacccaaattacctgaacgacttagttcaccaaatggaattgcaaaaaaatcaaaatgagtcattgtatattaattactacttttatccaattttcgattcgttgtacaatttctccttgggttctattgcgggttgtattggtgcaactgtagtatacccaatagactttataaaaacaaggatgcaagcccaaagatctttagcccaatacaaaaactcaattgattgtttgttgaagattatatcccgcgaaggaataaaaggtctctactctggcttagggccacaattaataggagttgctcctgaaaaggcgataaaattgactgtcaatgattttatgagaaacaggttgactgataaaaacggcaagctaagcctttttcctgaaattatttctggcgcttcagctggtgcatgtcaagttatatttactaatccgttagagattgtaaaaattaggctacaggtccaatccgactatgttggtgaaaacatacaacaagccaatgaaactgccactcaaatagtcaaaaaattaggactgaggggcttgtacaatggtgtagccgcatgtttaatgagagatgttccattctctgctatttattttcccacttatgcacatttaaaaaaagatctctttgattttgatccaaatgataaaacaaagaggaatcgattaaaaacatgggagcttttaactgccggtgccattgctggtatgccagctgccttcttgactactccttttgatgttataaaaacaaggctccagatagatcctcgaaaaggtgagacaaagtataacggtatatttcatgctatccgaactatcttaaaggaagagagctttagaagctttttcaaaggtggtggagcccgtgtcctaagaagttctccccaatttgggttcactctggccgcctatgaattattcaagggctttattccctcccccgataacaaattaaaaagcagagagggtaggaagagattttgtatcgatgacgacgcaggcaatgaagagacagtagttcatagtaacggtgaactcccacagcaaaagttttactctgatgatagaaaacatgccaattattactataaaagctgtcaaattgcgaaaacattcattgatttggacaataacttttctaggtttgactcttcagtttataaaaactttcaagagcacctaagaagcattaacgggtga

SEQ ID NO: 251 - DNA, 396 bp, Saccharomyces cerevisiae
atgtttggcccattcaaattaacaagccccgtcgctggtggcctactatggaaaattccatggagaatgtccacacatcaaaaaacccgtcaaagggaaagattaagaaacgttgatcaagtcataaagcaattaactttaggtctccacgtccaaagatgtcaggataaaggtcttacttatcaagaagccatggagagcaaaaagaaatacaagccaagaagtaaatcgttaaggttgttaaacaaaccatcagtctttccaaaggagaatcaaatgtcttctaaagataaatattggacttttgataaaaaagctgttggttataggaagggtattcataaggtgcccaagtggacgaagatttccattagaaaggccccaaaattcttttga

SEQ ID NO: 252 - DNA, 765 bp, Saccharomyces cerevisiae
atggttagagttgtcatagagagtgaattggtccgtacagaaaaggaattaccaaattcgcttaaattaaggcagttcaaggaccgattgtaccatgttaccggagtggaaccagaggatatggaaatagttgtgaaaagacagtacgacaacaaggagatatatagtactaaaaaggggggtgcctattcaaatgaggatgaagatgccaacttcctaaaaggagaggaggagcttattgtggttgttacagactctaatgcccaatcaatctctaaccagctggccacgcaagcggaaggaatcccctcaatggaagtaattagcgaggaggattatttgcgaagggatcaatccgtattacgatggaagatggctcacggctatggtaggtttaatgctgcacagcagagccagcgcgctgcgctggcaaagcaggacgaagcatatgcccgagagcaattaacggcggctatcggccgccactgtcgtgtcacagtagacgggagcgctccacgtgaggccattttacggtacgtaggaccactaccgttggacgtgatgggcacatggtgcggtgtggaattcccggaagccgcaggcaaaaacgatgggcgcataaatggggtaacactgtttgggcctgtggcgccgggtcacggatcgtttgtgcgtccgcgggctgtggaaattctatcaaaagacgaagaatccgccgaggtggaagacgtccatgatgacgtggagagcgatgatgaaatttga

SEQ ID NO: 253 - DNA, 363 bp, Saccharomyces cerevisiae
atgagatggcattgtatggatgggggtaatagaattgtatctatgtatctgacgaccctgtattacacgaaggaaatagtagatgaaaagacaagagagcaagaaaaaggaaaaacttcctttctaacagacgctttacttaaccttatatatatcttatttttttcatcgagcgtgttcaattggacaaggtgccaccttttcgacacttcggttattatgttacacagttttcatgaggatggcgccttgactaacttaattagtcatttgccaaccaccacagttccccaatatcgacagcttcacgtgccatttgccattttgcgatcatgtgacctcaagagaaaaagcaaaaaataa

SEQ ID NO: 254 - DNA, 1845 bp, Saccharomyces cerevisiae
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttatatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaataccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaaacacctcatctgttgtgaacaaatga

SEQ ID NO: 255 - DNA, 2580 bp, Saccharomyces cerevisiae
atgtcttcgtgctctctgcatttggattcgtctgaaaagttgaaattcgaaattatcggcggtaacaacggtgttatcaggtggcatttaaaggggaaccaccccatcgagacaaatagatgggtttgggccatccagggcgccataagatacgcaaaggacagagaaattttgctgcacaatggcccctattcgccttctctggccttaagccatggcttgtcatccaaagtgtccaataaagaaaacttgcatgcaacttcaaaacggttgaccaagagcccgcatctgtccaaatccacactgacacaaaacgatcacgataatgacgatgacagcactaacaacaacaacaacaaaagtaataatgattatgacgataataataataataataataatgacgatgatgattatgatgatgatgatgaaagtagacccctcatagaaccattaccgttgatttcatccagaagccaaagcttaagcgaaatcactcccggtccacattctaggaagtctacagtctcgtctacaagggcagccgatataccatcagatgatgagggttactctgaggacgattctgatgacgacggtaactcctcttacacaatggaaaacggcggtgaaaacgatggcgacgaagatctaaatgccatttatggtccctatattcaaaaactacacatgctacaaagatccatttccatcgagttggcatctttgaacgaattgctgcaagataaacaacaacacgatgagtactggaacaccgtcaacacttctattgaaaccgtcagcgaatttttcgacaaattaaatcggttgacctctcaaagggaaaaaagaatgattgcccaaatgaccaagcaacgggatgttaacaatgtttggattcaatcggtaaaagatctggaaatggaactggttgataaagacgaaaaattggttgccttggataaagaacggaaaaatctgaaaaaaatgcttcaaaaaaaattgaacaatcaaccacaggttgaaactgaggctaatgaagaatccgatgatgcaaattcaatgataaaaggatcccaagaatcaacaaatacccttgaggaaatcgtaaaatttatcgaagcaacaaaggaaagtgatgaggattctgacgccgacgaatttttcgacgcagaagaagctgcttccgacaaaaaagccaatgattcggaagacttaaccacaaacaaggagactccagctaatgcgaaaccacaagaagaagctcctgaagacgagagccttattgtgatcagttctccacaggtggaaaagaagaaccaactattaaaagagggatcattcgtcggatatgaagacccagtgagaaccaaactggctttagacgaagataatcgtcccaagattggtctctggtctgttttaaagtctatggtcggtcaagacttaaccaaactaactctaccggtatcgttcaatgagccaacatccttactacagagagtatctgaagatattgagtattctcatattcttgaccaagctgccacttttgaagactcctctttaagaatgctatatgtagctgcctttactgcatcaatgtacgcatctaccactaacagagtgtctaaaccattcaaccccttactcggtgaaacttttgaatatgccagaactgatggtcagtaccgattcttcaccgaacaagtctctcaccacccacctatctctgctacttggacagaatcgcccaaatgggatttttacggtgaatgtaatgttgattcgtcattcaatgggcgcacgttcgccgtgcaacatttaggattatggtacattactatccggcctgatcataatattagtgttcccgaggaaacttattcctggaaaaaaccaaataacactgttatcggtattttaatggggaaaccacaagtagacaacagtggggacgtcaaagtcacaaaccataccacaggcgactattgtatgctgcattacaaagcccatggctggacctcagccggtgcatatgaagtcagaggtgaagtattcaacaaggacgataaaaaattatgggttcttggtgggcattggaatgattccatttacgggaaaaaagtaactgctagaggcggagaactgacattagacagaataaaaacggcaaattctgccacgggaggaccaaaactagatgggtctaagtttctgatatggaaagcaaatgaaaggccttcagtgccatttaatttaacgtcgtttgcattgactttgaatgctttgccaccccacttgataccatatttagcacccacagatagtcgtttaaggcccgatcaaagggctatggaaaatggtgaatacgataaagctgccgcggaaaagcatcgtgttgaagtaaaacaaagggcagcaaaaaaagaaagggaacaaaaaggagaagaatacagacctaagtggtttgtccaggaggagcaccccgttaccaaaagtctatactggaaatttaatggagagtattggaacaaaagaaaaaatcatgactttaaagattgtgctgatattttctaa

SEQ ID NO: 256 - DNA, 1710 bp, Saccharomyces cerevisiae
atgaaactgaaaactgtaagatctgcggtcctttcgtcactctttgcatcgcaggttctcggtaagataataccagcagcaaacaagcgcgacgacgactcgaattccaagttcgtcaagttgccctttcataagctttacggggactcgctagaaaatgtgggaagcgacaaaaaaccggaagtacgcctattgaagagggctgacggttatgaagaaattataattaccaaccagcaaagtttctattcggtggacttggaagtgggcacgccaccacagaacgtaacggtcctggtggacacaggctcctctgatctatggattatgggctcggataatccatactgttcttcgaacagtatgggtagtagccggagacgtgttattgacaaacgtgatgattcgtcaagcggcggatctttgattaatgatataaacccatttggctggttgacgggaacgggcagtgccattggccccactgctacgggcttaggaggcggttcaggtacggcaactcaatccgtgcctgcttcggaagccaccatggactgtcaacaatacgggacattttccacttcgggctcttctacatttagatcaaacaacacctatttcagtattagctacggtgatgggacttttgcctccggtacttttggtacggatgttttggatttaagcgacttgaacgttaccgggttgtcttttgccgttgccaatgaaacgaattctactatgggtgtgttaggtattggtttgcccgaattagaagtcacttattctggctctactgcgtctcatagtggaaaagcttataaatacgacaacttccccattgtattgaaaaattctggtgctatcaaaagcaacacatattctttgtatttgaacgactcggacgctatgcatggcaccattttgttcggagccgtggaccacagtaaatataccggcaccttatacacaatccccatcgtaaacactctgagtgctagtggatttagctctcccattcaatttgatgtcactattaatggtatcggtattagtgattctgggagtagtaacaagaccttgactaccactaaaatacctgctttgttggattccggtactactttgacttatttacctcaaacagtggtaagtatgatcgctactgaactaggtgcgcaatactcttccaggatagggtattacgtattggactgtccatctgatgatagtatggaaatagtgttcgattttggtggttttcacatcaatgcaccactttcgagttttatcttgagtactggcactacatgtcttttaggtattatcccaacgagtgatgacacaggtaccattttgggtgattcatttttgactaacgcgtacgtggtttatgatttggagaatcttgaaatatccatggcacaagctcgctataataccacaagcgaaaatatcgaaattattacatcctctgttccaagcgccgtaaaggcaccaggctatacaaacacttggtccacaagtgcatctattgttaccggtggtaacatatttactgtaaattcctcacaaactgcttcctttagcggtaacctgacgaccagtactgcatccgccacttctacatcaagtaaaagaaatgttggtgatcatatagttccatctttacccctcacattaatttctcttctttttgcattcatctga

SEQ ID NO: 257 - DNA, 3369 bp, Saccharomyces cerevisiae
atgacgaaaaagaaagcagctactaattatgctgaaaggcaaaatttagccagtgaagattcttcaggtgattcggttcattttaaggactttattcccttacaagagttactgaaagataaaaattatgttccatcggtggaaaatttggagaagatcttatataatgaaaccatgtttaatgatcagaaaatatgctctaacctattgcttgaggctctcataattacgttgttcacaacaatttcagggaagtcagctttacgattaattcagacttcttctttgaaggaaagaaaatcctgggcccagtcctttgaaaataacagttctagctatgcttccatagtactgagttggaaagataatgatatattactcctgaaattcttaaggtttttattagcaaataaaacggcccctcttcaaattaatcggtacaatcttccagaatacaaactcccgttgagctttttaattgtttcaaaaattactattccgtccatattactcaatgaaacgtataatttgttaaaggactatttgtattcgataactggccgtatagagagtttgataagctgcagctccacatttgataagccagcacttgtcgttagaaaaattttaaaagattacaatagaatgatagaatgccgaaatttttatttctggtattcctttaatgctgagaacagagtaaatcttacttttagtgataacattagcctgttaatggaaaatgatgaaggcaatgctggaagtggccttgacgatagccgttttgatcatcaaaaacaaccgagagaggcgataatgggccgaacaataaatgaccaggaacaaatatattcattcgaactgaaccaagatggaacgcttgaaatacccaacgttatggagcattctttactaagacacgagcttctttttaaaatattaaatctcactacggtattgacgccattattggaactacaattttctacgctatgtggcttagtagatccattaatgcagcctactcccaatgataagcatattatatcgatagactttctttttcagctttttttgggattaatgtctcagtcgatcaagacttctcaagaacacaacgaccattatgactggaaattttatatgtgttttaacatgcaaaaaattattgatgctaccatgttgaggctcaactgctttgattttgatatattaaactcggtaaacaatacagataatgcagttcattggaagacgcaacttcacagatggctaccgcatggcctgaatacacaagacttggaattactctatatgattgatatactggcggtatataccatctacaagttgtatgaaaaaatacctatacaactaaacccatttttattttcattaatatccttatggaaaaacctctcctgtgttatacttttagccttagaaattgatagaattgaagaggagaatggcacttacgaaacgccgcttatggttcgcgccacaattcgtggagccgcagcattgaggtctgtaatagctaccgttctcaatggattagtgaaaaataatgatcatgatttcaagcacgagtctttaaacacattcatgtcgccctatggaagaaaattgtgtcatggtgctttatatgccgatttaaggtcacatactgcatctctacttgcgcttggagcaagcatcgaagatgtaacagatttatttgccgatttacagtcaggtgatagatttgatgaggatattagatatatgtttgattatgaatgtgaagattatgatgaatctttctctgaaagcgatcatggaggattggatgaaagcgttgttaacccaacagaaaaaatagcatctggtagtaataatgttttctttcggagacggtgcaattgcatcttcaatgatgataagttggtggcagaggatggtgcaaatgaagcctttgggtcaacaaatagcgaaaacgttgaaggcgcaatgcataataataggaatgcggtacataacgcgactacagccacttctgatcacgtcgttacgtcacctaacccactttccgttagatcaagaagtacttttgaatttgactatagtggggaagattggagggacgttcccagagatttcaatatgtactattcgccatcttattcattcatccatgagcctaagttagatgtcatatttagtttgactctacgtggcgcaacagaaaagttgaataaggaggaatccatattgttagtgcgttcagttgcatcgtgtgtaaggaacgagcaggaccaaatgattttagcagacctggagtctaatttttccgcaagtataaacggcgatgtagaaggtgaaggaaataccaaaatgtccaagatagataatgaagatctcagaagaaccacgccggatgatatttatgaaatatggtctgaagaatcagcatttgaaaggatgctaaacgtgaatcacgacgttgcgtggagattaatggatgaaatgttaatgtgcaccggttataggagaatattgatatggttccttacgcatttggagttaaaacattcgttgatatattacgtttttgaactaataatggggttacgtggaaaaccgttttccggagaagccagtgatcaagataaaaaggatgatatgatatatgagatcttgaagaaaaagcagaagaatgaagatgcttcaggacttcccttttcaaggcaaggacctatcgtattatctgatattgagactaaaatgttactgcaggagttttttatgaatgctgctatttttttgtcatcaaaaaataacgaagaagagaatgaagacggcgagaaaatctccttgtactcccttggtttggttaggttgatctgttacatggtgcagacactcatcgcgaacgacaagtttttttttaccaaatcagaatgcacttttgagcttcaaactttactgatgacatggattggcatccttcctgaagccaaagatttattctttaagatcaagacaaggctcgccatggaagaagaggatagtgccgatactatgcagcatgagggcaggaagaactctgacatagagaagaagctaaacgctaagccagcttctgaactgaatctgaaattgttaaacctgtttccctcaaagcctgcaaacaaagacgatagttcccctattaacacgttgcgtagttttatcgctgattactccttcgacacccaggtgaaccctccaggaagaagggtggtgttctacgatggtaagattttgccattgcccaaagccgataagcctatcccacttcatgaatatataacactcgcagagctcgatgttggagacagtgagtga

SEQ ID NO: 258 - DNA, 1689 bp, Saccharomyces cerevisiae
atgcaaacactagacgagacttcaaatctactccctccacctgaggaagctgaagcccctcccttggaacaaaaatttcatgaatataatttggccttacctaagtttcccattttgttttcgctatggttgggtagttttttgagttccttggatagcactattgtcgcaaatataatgaatagagttgctgaggaattctctgaatcaagtaaaaagcaatggattgcgacgagttttcttttgacaaatacggctttccaaccactatatgggaagctttctgatataacagggcggaagtcagcattattaaccgctcaatttttttttggccttgggtgcttattaacatgttttgccagaaacgtcacggaattctcaatagcaagagccatatgtggtattggtgcaggaggattgaatgctattagtagcattgctgttagtgacatatgtacagcaagagaaaggggcgtttaccagggatatgcgaatattgttttcgggtttggtcaattactaggtgctccgttgggtggtgtatttatagaaaccattggatggagggctctttttggtatccaagtacccgtgataatgttgtgctcggtattagcaatcaaaaacattaatattaagctattccatgttcctcctatgaaagaaagatataccttaaagaatctgtcacggatagatatatttggctcattaagcctggtggcgaccattagtggagttttatttttgtgctctagccagttgaacaagttgtatttagcattgtttaccattggtagctttattgtttttatcctggttgaacgttattacgcgactgagaaaattttaccattcgaactattgactcgctcattctgtttgagctcagcggtaacggttatatcttcatttgttgtatttggtgaaatctttaggtcaccaatctatttacaattgcttcaaaatattagtgtaacaaagactggcctctttttgattttcccctctatatcagttgcagtcggatcattggtaacaggatgggtattgcggaatacgaaaattaacctagcacactgtgcatatcaaatcatttttggtggtatgataatgcagctattgggtttgggattgggctatttcctactttcacacttgaatcctgactacaccatatatgatatgcttgagtctattacattcagatctaactcaatatggtggaaattgatatatgtgtttgcatcagtccttgtgtcctttggttacgcttgtctattagtggccacgttagtaagcatcgtattcaccgtcgaaaaatcacagcaaggaaccatgactggtgttttctatttgtggagatccattggtaacgttcttggtgcctctttaactttagtgtcctatgagaatagcctgtcgtccatgttatggaattatatgttcaaaaccaagcgtgatgacgaatatcacttcaccaaaaagcagtactactcccttatcaatgattcgagttacttgagagggcccaattttccaacggatatatttgttcgcattcttgatgtctacaaaaaggcattcctgatttcctatattccaaatatagccctggcagcagtgggaattgttttatcgttatatctggtgaaacatacttacaaacgtagttcaagttcttga

SEQ ID NO: 259 - DNA, 3234 bp, Saccharomyces cerevisiae
atggaggaaggacctatcaaaaagaaactgaagtcagcaggtcaagggagtggaaagaccgatgcctttagaaattttgaacaattttttttccgccttaatactctttacacctttttgatttgcagaaagcatgttgtgcctacatttaaaacactttgtggacctatagaaactgctttgaaaagaactgtgacgaaagaagacctagccatggttatggcgctaatgccaagagaatgtgttttcaagtatattgatgagaaccaaatttatactgaaactaagatttttgacttcaataatggcggctttcagcagaaggaaaatgacatatttgaactgaaggacgttgatgaccaaaatcagactcaaaaatctactcagttacttatatttgaatttatagacggtacaatgcaacgctcatggtctgcaagtgatagattttctcaaataaagataccaacatatactacggaggaaatgaaaaagatgatttctaaaagggaagctctctttaaatccagactacgggaatttatcctggaaaaggaaaaggctaaccttgacccattttctgagttaacaaatctagcgcagaaatatattccaagggagagagattatgaggatcctattgaggcaatgatgaaggcgaagcaagaaagtaatgagatgagcattcccaattattccaataattcagtgataacaacaattcctcaaatgattgagaaattaaaaagtactgaattctacgcttctcagataaagcattgttttacaataccatcaagaacagcgaagtataaaggtctctgttttgagcttgcaccggaagtatatcagggtatggaacacgaaaatttctacagccatcaagcagatgcgataaacagtcttcatcaaggcgaaaacgtcattattacaacatcgacctcttcaggtaaatcccttatttaccaactagcagctatcgatcttcttttaaaggatcctgaatcaacgtttatgtatatatttccaacaaaggccctggcacaagatcaaaaaagagcattcaaggtaatactttcaaagatccccgagctaaagaatgccgtggttgatacgtatgacggcgatacggagccagaggaaagagcttatattcgtaaaaatgctagagttatttttaccaatcctgacatgatacataccagcattttacctaatcatgcaaattggagacattttttgtaccatctaaagttagtggtggtcgatgaattgcatatatataagggtttatttggatcgcacgtggcattagtgatgagacgtttactaagactgtgccactgtttttacgaaaatagtggtttacaatttatttcatgttctgcaactttaaagtctccagtacaacatatgaaggacatgtttggaattaatgaggttacgctaatacacgaggatggctcacctacaggtgctaagcatctagtggtgtggaatcctccaattttacctcaacacgaacgtaaacgagaaaatttcattagagagagtgcaaagatattggtacaattgatattgaacaacgtaagaaccatagcattttgctacgttcgtcgtgtttgtgaattgttgatgaaagaagttcgcaatatttttattgaaactgggcgtgaggatctggttacagaagtcatgtcttacaggggtggttattctgcttccgacagacgtaaaatagaacgtgagatgtttcacggaaatttaaaggctgtcatatctaccaatgctctagaacttggtattgatatcggtggactagacgcagtcttgatgtgcggtttcccactatcaatggcgaattttcatcaacaaagtggtagagctggaagaagaaataatgattctttaaccctcgtggttgcaagtgactcgcctgttgatcaacattatgttgctcatccagaatccttgctggaggttaataatttcgaatcttatcaagatttggttcttgatttcaataacattttgatactggaaggacacatacaatgcgctgctttcgaactgccaataaattttgaacgtgacaagcaatactttactgaatctcatcttcgcaaaatctgtgttgaacgcttacatcacaatcaagatgggtaccacgccagtaatagatttttaccatggccgtccaagtgtgtatctttgagaggcggagaagaagatcaatttgccgtagtggatataacaaatggaagaaatataataattgaggaaatagaagcatccaggactagttttactttatatgatggcggtatattcattcaccaaggctatccctaccttgtgaaggagtttaatcctgatgaaagatatgctaaagtgcaaagagtagatgttgactgggtaaccaaccaaagagactttacagatgtagatccacaggaaattgaacttatacgctctttaaggaatagtgatgttcctgtttactttggtaagatcaagactacaattattgtatttggcttttttaaagtagacaagtacaagaggatcatcgatgccatcgaaacccataaccctcctgtaataatcaattctaaaggattatggatagatatgccaaaatatgccttagaaatttgccaaaagaagcaattaaatgtagcaggagctattcacggggcgcaacatgcaattatgggtatgttaccgcgatttatagtggcgggtgtggatgaaatacaaactgaatgcaaagctccggaaaaggaatttgcagaacgtcaaactaaacgaaagcgaccagctagattaatattctatgattccaagggcggtaagtacgggtctggcttgtgtgttaaagcgtttgagcatattgatgatattatagagtctagtttaagaagaatagaagaatgcccatgcagcgatggatgtcctgactgtgtagcggcttctttttgtaaggaaaacagcctggtcctgtcgaaacctggcgcccaagtcgttttgcattgtattctaggtcactcggaagatagttttatagatcttatcaaagatggtccagagccaaatatgccagagataaaagtagagactgttattcctgtgtcagagcatgtcaacttttcagatgattttaagattattgacgttagaagagctacgaaagacgatactcatacaaatgaaatcattaaaaaagagatatga

SEQ ID NO: 260 - DNA, 573 bp, Saccharomyces cerevisiae
atgatcattgtggtacttattcccacgcataaccgactacggcaccacaacgacgcaccaatgccatctgacgtagcatcgaggaccgggctgccaaccccgtggaccgtcaggtatagtaagtccaagaaaagagagtattttttcaatccagagacgaagcactcgcaatgggaggagcctgagggcaccaacaaggaccagctacacaagcacttaagagaccatccagtgcgtgtaagatgcctgcacattctcatcaagcacaaggattcaagaagacccgcatcgcatagatccgagaacattacgatatccaagcaagacgctacggacgaactgaaaaccttaatcacgaggttggatgacgactctaagacgaactccttcgaggccctggctaaagagagatcagattgctcttcatacaagcgaggcggcgacctcggctggttcgggagaggcgagatgcagcctagctttgaagacgctgccttccagctcaaggtcggcgaggtaagcgatatcgttgaatcaggaagcggtgttcatgtgatcaagcgggtaggttag

SEQ ID NO: 261 - DNA, 2580 bp, Saccharomyces cerevisiae
atgatcaataacgaaccatttccatctgccgactcagcatcgattttaactacgtctacatcaaataactccttaatgtcttacaatcatcagcctcaactatctattaactccgtccaatcactcttggagcccgtgacccctccgcctttgggccagatgaataacaaaagaaaccatcaaaaggctcattcgcttgatctctctggttttaatcagttcatatcatcgacacaatctcccttggctttgatgaataatacatcaacatcgaattctgctaactctttttccccgaatcctaatgctgctagcaactccactgggctttcagcctcaatggcaaatcctccagccattctaccattaatcaatgagtttgatctggaaatggatggtcccaggagaaaatcaagccacgatttcacggttgttgctccttcgaactctggtgtcaatacctccagtttaattatggaaacaccatcctcttcagtgactcctgctgcatctctcagaaattttagcaatagtaataatgctgcttccaaatgtggagtggataattcgtcatttggtttgagtagctcaacgtcttcatctatggtcgaaatcagcgcactaccccttagagatctggattatatcaaacttgccactgaccagtttggctgccgttttcttcaaaaaaaattagaaacccccagtgaatccaatatggtgagagacttgatgtatgaacaaattaagccatttttcttggaccttattttggatccgttcggtaactatttggttcaaaaactatgcgattatttaactgccgagcaaaagacattattaatacaaacaatatatccaaatgttttccaaatatcaatcaatcagtacggaactcgttccttacagaaaattatagacactgtcgataacgaagttcaaatcgatctcattattaagggattttcccaagaatttacttcgattgagcaagtggttactttgataaacgatcttaatggtaaccatgtgattcaaaagtgtattttcaaattctcgccatcaaaatttggtttcatcatagatgctattgtagaacaaaataatatcattaccatttctacccataaacatggttgttgcgtactacaaaaattactaagcgtttgtactctacaacaaattttcaaaatttctgtgaaaattgtgcagttccttcctggattaatcaacgatcagttcggtaattatatcatccaatttctgttagatatcaaagaattggacttttacttattggctgagttatttaaccgtttatccaatgaattatgtcaactatcttgtttgaagttctcctcaaatgttgtggaaaaattcattaaaaaattatttagaatcattactggatttattgttaataacaatgggggtgcctcccaaaggactgcagttgcttctgatgacgtgattaatgcttctatgaacattcttttgactaccattgatatattcacagtcaatttaaatgtgctaatcagggataattttggtaattatgcgttacaaacgctattagacgttaagaattattctcctctgcttgcttacaacaaaaatagtaacgcaattgggcaaaacagctctagtacattgaattacggtaacttttgtaacgatttttcattgaaaattggtaacttgattgtccttacaaaagaattacttccaagtattaaaactacatcctatgcaaagaaaattaagttgaaagttaaagcttatgcagaagccacaggtataccattcactgacatatctcctcaagtcactgcaatgagtcataacaatcttcaaacgattaacaacgaaaataagaacccccataacaaaaatagtcataatcataatcataatcataatcataaccatgctcacaataataataacaataataatcaaaagagtcatacccgtcatttttctttaccagctaatgcttaccatagaagaagtaacagctctgtaaccaataatttctcaaaccaatatgcacaagatcagaaaattcactctccgcaacaaattatgaacttcaaccaaaacgcatatccctcgatgggagcaccttctttcaattctcaaactaacccaccattggtaagccataactcgttacaaaacttcgacaaccgccagtttgcaaatttaatggcacatcctaattctgctgcaccaatccattcgttctcatcatctaacattaccaatgtgaatcctaatgtttcaaggggatttaagcagcctggatttatgatgaatgaaaccgacaaaattaatgctaatcacttctcgccatactctaatgcaaatagtcaaaacttcaatgaatcttttgtgcctcgtatgcaatatcaaacggaaggtgcaaactgggattcaagtttgtcaatgaagtcgcagcatattggtcaaggcccatataatcaagttaatatgagccgcaacgctagtatttccaatatgcctgccatgaataccgctagaacatctgatgaacttcaattcactttgccataa

SEQ ID NO: 262 - DNA, 1572 bp, Saccharomyces cerevisiae
atgtcctataaacaaacaacatattatcctagcaggggtaatctggtaagaaacgactcatctccgtacactaatactatttcctcagaaaccaacaatagcagtacaagcgtattgagtcttcaaggcgcatctaacgtgagtttagggaccactggtaaccaattgtacatgggcgacttggatcctacatgggataagaataccgttaggcaaatttgggcatctctgggagaagcgaatattaatgtccggatgatgtggaataatacgcttaataatgggtcgagatcatcaatgggtccaaagaataatcaaggatattgctttgttgattttccctcatctactcatgcagcaaatgcacttttaaagaatggtatgcttatacccaattttccaaataaaaaattgaaattaaactgggctacatcctcatattcaaacagcaacaattctcttaacaacgtgaagagtggtaacaactgttctatatttgttggagacttagcaccaaatgttacagagtctcaattatttgaacttttcattaacagatatgcttctacttctcatgccaaaattgtgcacgaccaggttaccgggatgtctaagggctacggttttgtaaagtttaccaattctgatgaacaacagttagctctgtcagaaatgcaaggcgtatttttaaatggtagagccataaaagtaggacccacatctggtcagcagcagcatgtcagcggtaacaacgattacaaccgtagttcttcgtcactaaacaacgaaaatgtagactcgagatttctttccaagggtcaatcatttttaagcaatggaaataataacatgggctttaagagaaaccatatgtctcaattcatttatccagtccaacagcagccgtctttaaaccacttcactgatccgaataacaccactgtgtttatcggaggattgtcatcactggtgactgaagacgaattacgtgcttatttccaaccttttggcacgatagtctatgtcaaaattccggtaggcaaatgttgcgggtttgtccagtatgttgatcggctatcggctgaggctgccattgctgggatgcaagggttccccattgcaaattcaagagttagactgtcttggggcaggtctgctaagcaaacagcgttgcttcagcaagccatgttaagtaactctttacaggttcaacaacagcaaccaggtttacagcaacctaactacggatacattccatccagtacgtgtgaagcacctgttctgccagataataatgtttcatccacgatgcttcctggatgtcaaattctgaattattctaatccatacgctaatgcgaatggattaggctcgaacaatttcagtttctacagtaataataatgctacaaatacgcaagctactagtttactggctgacactagctctatggacctctcaggcacgggtggccaacaagttatcatgcaaggaagcgaagcggttgttaacagcactaatgcaatgttaaaccgtttggaacaaggcagtaatggttttatgtttgcttga

SEQ ID NO: 263 - DNA, 2169 bp, Saccharomyces cerevisiae
atgaagggaaactttaggaaaagagatagctccaccaactcaagaaagggtggtaattctgacagcaattatacgaatggaggcgtccctaatcaaaacaacagttcaatgttctatgagaaccctgaaattacgagaaactttgatgaccgtcaagattatttgttagccaatagtataggctctgatgtaacagtaactgttacttcaggtgtgaaatataccggtttattagtatcttgtaatttggaatctactaatggtatcgatgttgtattaagatttcccagggttgctgattcaggagttagtgattctgtggatgacttggctaagactttgggagaaaccttgctgattcacggtgaagatgtcgctgagttggaactgaagaatattgatttgtctcttgatgagaaatgggaaaattccaaagcccaagaaacaacgcccgccagaacaaatattgaaaaggaaagggtaaatggagaatcgaatgaagttacgaaattcaggactgatgttgatatttctggttctggtagagaaattaaggagcgtaagttagaaaaatggacacccgaagaaggcgcggaacattttgatatcaacaagggtaaagctttggaagacgattctgccagttgggatcaatttgctgtgaacgagaaaaagtttggcgtaaagtcaacttttgatgaacatttgtatacaacaaagattaacaaggatgaccctaattacagtaagaggttgcaagaagccgaaagaatcgctaaggaaattgaatcgcaaggaacttccggtaatattcatattgcagaggacagaggtatcataattgatgattctggtctagatgaagaagacttatactctggtgttgatagaagaggagatgagttgttggccgctttaaaaagcaattctaagcctaattccaacaaggggaataggtatgtcccacctactttaagacagcaacctcatcatatggatccagcaattatctcttcgagtaattctaacaaaaatgaaaatgccgtttccacggatacctctactcccgcagcagcaggtgcgccagagggaaaacccccacaaaagacttctaagaataagaaaagtttgagtagcaaagaagcccagattgaagagttgaagaaattttccgagaaatttaaagttccatatgatattccaaaagacatgctagaagtcttaaaaaggtcaagctctacattaaaatctaattcttcgttgcctccaaaaccgatcagcaaaaccccttcggccaagactgtttctcctactacacagatttctgcagggaaatcagaatctagaagaagtggcagcaacatatctcaaggccaatcatctaccggccataccacgagatctagtacttcattgagaagacgtaatcatggttccttttttggtgccaagaaccctcatactaatgacgccaagagagtgttgttcggaaaaagttttaatatgttcatcaaatccaaggaggcccacgatgaaaagaagaaaggcgatgatgcctcggagaatatggaacccttctttattgaaaaaccttattttactgcgccaacctggttaaatacaattgaagaatcgtataagacatttttcccagatgaggatacggcgattcaagaagctcaaactaggttccaacaacgccaattgaactccatgggcaatgctgtgcctggtatgaatccagctatgggcatgaatatgggcgggatgatgggctttccgatgggaggtccatcggcatcaccaaatccgatgatgaatggctttgctgctgggtcaatgggtatgtacatgccatttcaacctcagccaatgttttatcacccatctatgcctcaaatgatgccagttatgggtagcaatggggctgaagaaggaggaggaaatatttcgccccatgtccctgcaggttttatggcagctggccctggcgctcctatgggtgccttcgggtatccaggagggatacccttccaaggaatgatgggatcaggtccatctggcatgccagcgaacgggtcggcaatgcacagtcatggccatagtagaaattaccatcaaactagccaccatggccaccataatagtagtaccagtggccataaatag

SEQ ID NO: 264 - DNA, 3402 bp, Saccharomyces cerevisiae
atgctaagaacaagaaccacaaagacccttagcacagtggcgaggaccacaagagctatccaatattaccgatctatcgctaagactgctgcagtttctcaaagaaggttcgcatcgaccttgaccgtgcgtgacgtagagaatatcaaacctagccatattattaagagtccaacatggcaagagttccagcatcaattgaaggatccaaggtacatggaacactttgcacaacttgatgcacagtttgctcggcatttcatggctacaaacagcggcaaaagtattctggcgaaagatgatagtacatctcagaaaaaggatgaagatgtcaagatagtacctgatgaaaaagatacagacaatgatgttgagcccacgcgagatgatgaaattgttaataaggaccaagaaggtgaagcttcgaaaaactccagaagctccgcttctggaggtggacagtcatcatccagtcgatcggattctggagatggaagttcgaaacaaaagcctccaaaggatgtaccagaagtatacccgcaaatgctagcattaccaatagccagacggcccttatttccagggttctacaaggcggttgtgatatcggacgaaagagttatgaaggcaatcaaggaaatgttagaccgccagcaaccctacattggcgctttcatgttgaagaactcggaagaagatactgatgtaatcacagataaaaatgatgtatacgatgttggtgttctggctcaaataactagcgctttcccgagtaaagacgaaaagacgggcactgaaacaatgactgctcttttatatcctcacaggagaataaaaattgatgaattatttccaccaaacgaggaaaaggaaaaatcaaaagaacaagcaaaggatacggatactgaaacgaccgtcgttgaagacgctaacaacccagaagaccaagaaagcaccagccctgctacgcctaagttggaggatattgtggtggagaggataccagactcagaattgcaacatcataagagagtagaagccactgaagaagagtctgaagaattagacgatattcaagaaggtgaggacattaaccccacagaattcttaaaaaattataatgtttcccttgtcaatgtgttgaatttagaagatgaaccgtttgatagaaagtcacccgttattaatgcgctaacatcagaaatattgaaggtatttaaagaaatttctcaattgaacacgatgttcagagaacaaattgcaactttttctgcttcaattcaatctgcgaccacgaacatttttgaggaaccagctagattggcagattttgccgctgctgtttctgccggcgaagaagacgaattacaagacatactgtcatctttaaacattgagcacagactagaaaagtcgctactagtccttaagaaagaattgatgaatgccgaattacagaacaaaatctccaaagatgtagagacaaagattcaaaagagacaaagagaatactatttgatggaacaattaaagggcatcaaaagagaattaggtattgacgacggccgtgacaaattgattgacacttataaagaaagaatcaagtcattaaaattgcctgatagcgttcaaaaaattttcgatgatgagataactaaattaagtaccttggagacttctatgtccgaatttggcgttatcagaaactatttggattggttaacatcgatcccatggggaaaacattccaaagaacagtattccattccgagagcaaagaaaattttagatgaagatcattatggtatggtagatgtcaaggatcgtatcttggagtttattgccgtcggtaaactattgggtaaagtcgatggtaaaatcatatgtttcgtaggacccccaggtgttggtaaaacgtccataggtaaatctatcgctagagctcttaacaggaaattcttccgattttctgtaggcggtatgacggacgtggcagaaataaaaggtcataggagaacgtatattggtgccttacctggcagagtagttcaagcattaaagaagtgccaaactcaaaatcctttgattttgatagatgaaatcgataagattggacacggcggcatacacggcgatccgtccgcggcattgttagaagtattggaccctgaacaaaacaacagcttcttggataactacttggatattcctattgacttatcaaaagtgcttttcgtttgcactgctaactctttggaaactattccaagacctttactggatcgtatggaagtcattgagttgacaggatatgttgctgaagacaaggttaagattgccgagcagtatttagttccaagtgccaagaaaagcgctggtctagaaaactctcatgttgatatgacagaagatgcaataacagcgttaatgaagtactactgtagagaaagtggtgtaaggaatttgaaaaaacacatcgagaaaatataccgtaaagcagccctacaagtggtaaagaagttgagtattgaagattccccaacgtcatcagccgacagcaagcctaaagaaagcgtttcttccgaagaaaaggcggaaaataacgccaaaagctcatcggagaagactaaggacaataattcggaaaagacaagcgatgacattgaagccttaaagacctctgaaaagatcaatgtttccatatcccagaaaaacctaaaagattacgttgggcctccagtctacactacagaccggttatacgaaacaactccaccaggggtagttatggggttggcgtggactaatatgggaggttgctcactttatgtagaatctgtccttgaacaacctttacacaactgcaagcatccaacatttgaaaggaccgggcaactgggagatgttatgaaggaatcatcaaggcttgcttattcattcgccaagatgtatttagcacaaaaattccctgagaacagattttttgaaaaggcgtctatccacttgcattgtcctgaaggtgctacccctaaagatggtccatctgcaggtgtcactatggccacttccttcctttccctagcattgaataagtcgattgacccaacggttgcgatgaccggtgaattgacacttaccggtaaagttttacgtatcggtgggttgagagaaaaagctgtggccgctaaaagatctggtgccaagactattattttccctaaagataacttaaatgattgggaggaacttccagacaatgtaaaggaagggttggaacctttagctgctgattggtataatgatatattccaaaaattattcaaggatgtgaatacgaaagaaggtaattcagtatggaaggctgaatttgagattttggatgctaaaaaggaaaaggactaa

SEQ ID NO: 265 - DNA, 1815 bp, Saccharomyces cerevisiae
atgcatttccccaaaaaaaagcattccggaaatctctccgtggtggaattgccgaaggaagctctccaagattctttaactgctgctcagattactttcaagagatatgcccaccccaatggcaatgccggtagcgcagagaggccgagacatctaaaggtggaatctgcgcctgtcgtgaaatctgagccttctttgccgaggatgagacaaccggaaccgagaagtataaatcatcaatactctagggaaacgcttccaggccattctgaagccttttccgtaccgacgactcctctgcagacaatccattatgatgtaaggaataaagcgtcaaattcgccaagtagtatagcagctgcagagacagctgcatacctagcccacacaaattcatttagtaacagatcatccggtgtcggcagccgggatccagttatggatactgaaacaaaaccgccacgtgctccttcagccttgaaaaatgagctgcaattgaacagaatgaggatacctccgccgtcatatgataataatgttcgttcacgatctatttcgccacaagtatcctactctacctcgctgtcatcatcgtgttccataagttccgatggagaagaaacttcttatagagaaaaaagcaccgatgaggcatttcctcctgaaccttccatgtcttcttatagtcttgcgtccaaagcctcagcaaaggcttctctaacggacccctcacagcggcagcaagagtcagactatacggcaatgaataaactcaatggaggaaatataatatataaaggcactttacccgacctaataccgcgaagccaaaggaagacaagtaaacccaggttcaagcacaggcttttacgatcacctgagcagcagcaagaaaacttatcacgtgtgtattcggaccaaacgcagaatggtagggcaatcataaacacgcagcaaaatgtaaagttaaagacaactatgaggcgcgggaagtacgcaattacagacaatgatgaaacttttccctacgacagaaagtctgtatcatcagactcagacacagatgaagattctaatgtgatggaaatcaaggacaagaagaagaaaagtcgtcgctctaagataaagaaggggttgaaaacaacagcagctgtagttgggagtagtacctctgtccttccgttccctcatcaccatcatcatcaccatcagctccataacccgaattctcatcacttacacacgcaccatcatacaagttctcacaaattcaatgaagataaaccgtggaaatctcatagagatctcgggtttattaccgaacaagaaagaaaaagatacgagtctatgtgggtatcaaacagatactcgtatttgcgcttgctgccgtggtggccctctctcgcgaatgaagacgacgagtctcacttacagcccttaaatttaccgcaagacggcctgatgcttaacttagtcgtaaaagatatatggtatcgatcaaacctacccagggatcttctagtgcaaatatacaatatggtcgacacaagaaaagacggtaccttagacagaaaatcgtttatagtgggcatgtggctggttgatcaatgtctctatggccgaaagctaacgaatgagctggaccagagagtttggaatagcgttgacggctatgttctcggtacaattaacgtgaagcctgccacttccgatcactatcacaacgctaataaccctctagataagccatcaaagctttcagtccgacaggaattgaaaaacatcaaacgcgatctcagaaatgtcagaatatga

SEQ ID NO: 266 - DNA, 1725 bp, Saccharomyces cerevisiae
atgtcaattaggcctctcacgttaaacggtttagatgagccagaaacctcttttgaagaactgaatacaactctacctcgctttcaatcccatgaaacattaactttggaagaaaacgtgccaccattgagtacatcaacttatataccgcctccatcctcggtaggtacttctgacactggcacggtattttccaatagtaccagcgcgttttggtctaataagcaagcagacgatgatcaggacatggaggtagaccaggatgatgaatttctaaatgacttccaggaattccaaaataaaaaggatgattttgacgatgctattaaaacaaattttcatttgagaaatggatgtcgaactggccctttcaaaaacgacattttcgcagaagagtttgatagaaaactgagtttggaagataaaccaaggctaaagcaacctagatcaatgatggaattgaaaccaaaaagaaaactatcaaatagcgtcacttcaagaaacttaaggtctggtaattctgtaagatttaagaaatctatgcctaacttagctttagttaatccagctatcagagaagaagaagaggacgaagaacgagaaagagaagatcaacgagagtttaattacaagattgataacgatacgcaggacacaattttggcgaaattcagttcagatgatgaaggtgactttctgacaggatttgaagaattagagggtgaagcaattgatgaaacgatttcttcgaacgataaagaaagtgccgaccatccgcgtttcttaaagaagtcatcctcatctttgccattaaaaatatcacctgcacaatatgatatagtaaagcatgacgaattattaactccaggtcttcataggcgacaacgagattggaatacccagcaggaactggactcttttaaagaaaaacgatcagtaagacactgttctaatcaaaatgtacaactcaatggtccagctaaaatcaaaacaataaaacagcaaattgatcataatactccaatgaagaaaggttctatgatatataacccgaaaactatgaagtgggaaggaaatgaaaacgtcttaagcaaatttagtgatgtagacacggcaaacaggaaagctttattgataaaaaacaagctacaacgagatgcagattctaagaagcaaaaatattctgatctacagcatgcaagagccacttcgagaaatcaaaaggtcatcgggaacatgattttagatgaacaaaatttaagatgggttagtgtttcagaggaagaagcagacccttttgcaggcattcctgagataaacttaccaccagttggcaaaagtatgaaaaaacgtagctcctcaccatttttgcgttccaaaagccaagttaatacgccatttgtttcaaatgacaatgatggcgtttatcaaagtacggctgctcaagcaagactccgtaaataccattcaatgaggacacttaacggtacaacagaaactccagaaataagctctactttccatttgagttcaagagcattggaaaaattttaccacgaggagaacaggtggtgtaaaaagttagcctcatggtttataccccgagatgagaccattatcagtgttgatgaggaaacaatcatggatgaaagtacggtcaatagcaagagaaaatcctatatgtatgaaatcaggaacatggtaatcaattcgacaaaagattag

SEQ ID NO: 267 - DNA, 513 bp, Saccharomyces cerevisiae
atgtttttaacgtcaccatttgaatcctgtattgtgctgtcttccttaatagcaggcttattgttttcattgtctaccgggttcgtaggtatactaggagtgtttgcctcattgttcgaaacagaactctcggtttcgccaaagagattatcactatcctcattatcttggccaaagacgttctgggccctgctttcttctgtagaaggtgtttcctgggaatctagcttattcgcttgcatagtcggctgctgctttgccgttaccgttatcgcctcactttctgcatcgcgtgtgttcggaacagttgcttcatccttcagagactcatcttgttgctgcgattcttcaccagcagtatctgtattggcaacccctgccacagctgcattagcgttgctatcactattgttgtcattgccatgttggtccacgtccacggaagcgtttaccgtggacccctcacccagtgtattctccatgcttgcaaaccgtatcacaattggtctctga

SEQ ID NO: 268 - DNA, 2358 bp, Saccharomyces cerevisiae
atgcccatcggtaacccaatcaatacgaatgatatcaagtccaaccgcatgcgccaggaatcaaatatgagtgccgtgagcaatagcgaaagtactattggccagtccacccaacagcagcagcaacaacaacaatatctcggccagagcgttcaacctctgatgcccgtatcctaccaatacgtagttcctgaacagtggccgtacccgcaatattatcagcagccgcaatcccagtctcaacagcaactgcaatcccagcctcagatgtatcaagttcaagaatcctttcagagtagcggttctgactcaaatgcttccaatccaccttccacgtctgtaggtgttccttccaacgctactgcaactgcgttaccgaatggttctgcaatcaccaccaaaaaaagcaataacagtactaatatcagtaacaatgtaccatactactattattttccccaaatgcaagcccaacaatcaatggcatattcgtatccacaagcgtattattattatcctgcaaacggcgatggaaccactaacggtgcaacaccatctgtaaccagtaatcaagtccaaaaccccaatttggaaaaaacctactcaacctttgaacaacagcaacaacaccagcagcaacaacaattacaagctcaaacgtatccggcccaaccaccaaagataggtaatgcattttcaaagttcagtaaatctggaccaccttctgattcgtccagtggctctatgtctcccaattctaatcgcactagtcgcaatagtaatagtatctcgtccttagctcagcagcctccaatgtcaaactatccacaaccttccacctaccaataccccggttttcacaagacttcgtcaattccaaactcgcattctccaattcctccaagatcattaacaacgccaactcaaggtccaaccagccaaaatggacctttaagctacaatcttccgcaagtgggtttgctaccgcctcagcaacaacaacaggtgagcccgttgtatgatggaaattctataactccaccagttaaaccctctactgatcaagaaacttatttaactgcaaataggcacggagtgtcagatcaacagtatgactcaatggctaaaaccatgaattctttccaaacaactaccataaggcacccgatgcccttaatcgccactaccaatgccacaggcagtaacaccagcggcacttcggcaagtataataaggccaagagtaacaacaacaatgtgggaggatgaaaaaacgctatgttatcaggtagaagctaacggtatttcagtggtaagaagagcagataatgatatggttaatggtaccaaacttctgaatgtaactaagatgacaagaggtagaagagatggtattctaaaagcggaaaaaatcaggcatgtggtgaagattggttccatgcatttgaagggtgtctggataccgtttgagcgtgccctagcaatagcacaaagagaaaaaattgctgactatctttatcccttgttcatcagggatattcagagcgtattgaaacaaaataatccaagcaatgatagcagtagtagtagcagtagcactggtattaaatccatcagtccgcgtacctattatcaacctattaacaactatcaaaatcctaatggtccttcaaatatatctgctgctcagctgacatactcctcaatgaatttgaacaacaaaattatacccaataattctataccagctgtaagtacaatcgctgcgggtgaaaagcccttgaaaaaatgcacaatgcctaactctaaccaactagaaggacatactataactaacctacagaccctttcggcaacaatgccgatgaaacaacaactgatgggcaacatagcttcacccttatcgtatccacgcaacgccacaatgaattcggcaagtacattaggcattacacctgcagattcaaagcctttgacaccttctccaactacaacaaacacaaatcaatcatctgaatcaaatgtgggaagtatccatacaggaatcacccttccaagagtggaatctgaatcggcatcacattccaaatggtctaaggaagcagacagtgggaatactgtaccagataatcaaacattaaaggagccacgatctagtcaattaccaatctccgcattgacttcgacggatactgacaaaataaaaacaagtacaagcgatgaagcaacacaaccgaacgaacctagtgaagcagaacctgtcaaggagtcagagtcatccaaatcacaagttgatggagctggcgatgtctccaacgaagaaattgctgctgatgatacaaaaaaacaagaaaaatag

SEQ ID NO: 269 - DNA, 2139 bp, Saccharomyces cerevisiae
atgcatagaacgcttctgtttttaacgtggctgatatctttaacaaaggcttttaatataaaattaccacacactgaaaaaaaagaccatttggaatccaacgctgtgctggcatgcgcatcctatataaatactctgaagtggtcatttgatagctccgtcgtaccgggtttctattctaccatatgctcttattcaccagcgtttgatacttggtcactttgtatcttcaattcgcttacagaccagattattcccatggacaacacaagtttcgaagaaagcttgggtaacgtacgaaaaacgtgctcgtttgtcgataaaaagtttagcaatatttcactggagcaatactactcatctttaaataatgcttcttctcacgctttggaagactatggttctattgaaagtttatcgacatccattcgagtcgatcgtgagacaagatctagatggatacgagcttttcatgcgcatgcctataatttagatatcagcagtgtttatggtgcatatttaacttactacttcgtcatagtgggtattatcgccgtcttcttccatatgagtcactataacggcctgaatcgagcgctatttgcaagccggttcgtcaattatattcggggccattttgtgttgcctacgtttttagtagataagcacgctaatcacttcaagtttctaaacgtggaagtctttacgggactgatgccgaattccttggaggcatggatcatttttggatacacattggcgaacatcatatttttgtccataagttacatcatagacccatataacctcattttcaacagtcacctgtcgcagtttacaagactgttggctgatagatctgggatactggcgtttactcagttccctctcattatcatttttacggcaaggaatagttttctcgaatttttaacaggagtcaagttcaattcctttattagtttccataaatggatcggtagaatcatggtcttaaacgcaacgatacattcgctttcttattcattattcgcaattatcaaccatgccttcaaaataagcaacaaacagctctattggaagtttggtattgcatccataacagtgctttgcgttctactagttctatcgctcggaatagtaaggaaaagacattacgaatttttcctgtacacccacatcatactagcccttttgttcttttactgttgttggcaacacgtcaaaattttcaacggttggaaagaatggatagtggtatccttgctcatttgggggctggaaaagcttttcagaatatggaacattttgcagtttagatttccgaaagcaacactaatcaatttgaacaccagcaacaacccgcacgatgaaatgtttaaagtaatcatacccaaatataaccggagatggcattcgaaaccgggtcaatattgtttcatttattttttacatccattggtattttggcaatgccatccatttaccattatcgacgaaggtgagaagtgtgttttagtgatcaaacctaaaagtggtctcactagattcatttataaccatattttgcaatctttaaatggtaaattacaactccgagtggccattgagggaccttatgggcccagtaatcttcacctcgataaattcgaccatttgctgttactaagtggaggaacaggcttgcctggtccattagatcatgccattaagctgtcacgaaaccctgataaacccaagagtatagatttgatcatggcgatcaaaaatccttcttttcttaacggctataaatccgagatactagagctaaaaaatagccgatcccacgtcaacgtgcaggtttaccttacacagaaaacagctgttacaaaggcagcaaacgcacgagaccaattaatacattttgatgatataatgaccgaactgacaagcttcgcccacatcggcaatgcaagacctaattttagcaatgtaattgaaaacgcaataaaaagtacgccgcctggagattcattagcggtcgtgtgctgcggccctcctgttctggtggacgatgttagaaacaccgtttctcaaaaactcctcggttacccagagagaattatagagtatttcgaggaatatcagtgttggtaa

SEQ ID NO: 270 - DNA, 2400 bp, Saccharomyces cerevisiae
atgagtaccatttatagggagagcgactcgttggagtcggagccctcgccaacgccaacaaccattcctatccagatcaatatggaagaggaaaagaaagatgctttcgttaagaatattgacgaggacgtcaataatctcactgcgactactgatgaggaggaccgcgatccggaaagccaaaaattcgacaggcattccatacaggaggaaggtctcgtttggaagggcgaccctacatacttgcccaattctccatatcctgaagtgagatcggcggtgtccatcgaggatgaccccaccatccgcctcaaccactggagaacgtggttcttgaccacggtgtttgtggtagttttcgccggtgttaatcaatttttttccctgagatatccatcgctagagatcaacttccttgttgcacaagttgtttgctacccaattggtaggatactggctctcttgcccgactggaagtgttctaaagtgccatttttcgatttaaacccgggcccatttaccaaaaaggaacacgccgtggtcacaattgccgtggcgcttacttcctctactgcatacgctatgtacattttgaacgcccagggaagcttttacaacatgaaacttaatgtcggatatcagttcttgttggtttggacatctcaaatgattggttatggtgctgcaggtcttaccagaagatgggtcgtcaaccctgcaagctctatctggcctcagactttaatttcagtgtccttgtttgattcgttgcactcgagaaaagttgaaaagacagtcgcaaatggttggacgatgccccgttacaggttcttcttaatcgtccttatcggatcgttcatctggtattgggtacctggattcctctttaccggtctgtcctatttcaacgttatcctatgggggtcgaagacaagacacaatttcatcgctaacacaatctttggtactcaaagtggtctcggtgcgttgccaattacatttgactacacccaggtttcccaagccatgtccggctctgttttcgccacaccattctacgtctccgccaacacctatgcatcagtgttgatattcttcgtcatagtgctgccatgtctttattttacgaatacctggtatgccaaatacatgcccgtcatttcaggttctacttatgacaacactcaaaacaaatacaacgtaacaaagattcttaacgaggattattccattaatcttgagaaatataaggaatactcaccggtattcgttccattttcctatcttttgtcgtatgctttaaattttgccgctgttatcgccgtttttgtccactgcatcttataccacggtaaagatattgtcgccaagtttaaagaccgtaaaaatggtggcactgacattcacatgagaatctactccaagaactataaggattgtcccgattggtggtatttacttttgcagattgtcatgatcggtttaggatttgtagcagtgtgctgtttcgatactaagttcccagcttgggcatttgttattgcaatattaatttcccttgtaaatttcatcccgcaaggtatcttggaagcaatgactaaccaacacgtaggtttgaatattatcacagaattgatctgcggttatatgctgcctttaagaccaatggcaaacttattattcaagctatacggatttattgtcatgagacaaggcttgaatttgagtagagatttgaaattagccatgtacatgaaggtttcccctcgtttgatctttgccgttcaaatctatgccactatcatatcaggcatggttaacgttggtgtccaggaatggatgatgcataatatcgatggcttatgtaccaccgatcaaccaaatggcttcacttgtgctaatggtcgcacggttttcaatgcttccattatctggtctttgccaaagtatcttttctcatcagggcgcatttataatccgctgatgtggttcttcttgattggtttgctattcccactagccgtttatgctgttcaatggaaattccctaaatttaaatttgctaagcacattcatactcctgtatttttcacaggcccaggtaatattccaccaagcacaccttataactactcattattttttgcaatgtcattctgcctaaacttgataagaaaaagatggagagcttggttcaataagtacaatttcgtcatgggggccggtgttgaagcaggtgtggcaatctccgtcgtcatcatcttcttgtgtgtacagtacccaggtggtaagctcagctggtggggaaacaacgtttggaaaagaacgtatgataatgattataaaaaattttataccttaaagaaaggtgagacatttggttatgataaatggtggtaa

SEQ ID NO: 271 - DNA, 2850 bp, Saccharomyces cerevisiae
atgagtatcaatcatgaaatatattatatacttgtatttgagcatcgttcagtagcaatcaagctcatcatcgtagtgattgttctccttcagttttttttagcacgaagtcggcaaattgataggacatgggcccatactaatagaaaggaacggttcagagaaatgacagctatcgggaatactgatgatgcacttgatactagtacagccgcaagtaaagaaaatggaaaaggtagactcagggttcaaaaagcttgtgaactttgcaagaagagaaaggttaaatgcgacggtaacaatccttgtctgaactgctctaaacatcaaaaagaatgccgttatgatttcaaagctacaaaccgtaaaagaagaagacgacaggtcgcatcagctgttcgggacgttagtaagacatatgcagaaaccagtgagtcttttcctagggacttgttaagtaaatcaaatattatcataaatgccccctcagatggtgtatcttcgtctgctagcaactctcccaatccaaattcacattatcatcatatatcatccactttacccttcatgagcggtaggccaaaccatacattccattccggaagcaacttaaatggagaaaataacaataacagttttccggaggatcacatggctaaattacttctgcaattgagttcaaaattggggaatacgaccaaggaatcgtcaattagaacaactagaaccaatgctagtgatgtgaatgcaaacccgacagtggtcaacatgaaaaatagtcaggaagactgtgacacgaatcacaggtctgcaatatgtgactctgcagaggctcttcataataacaacatcaattctaaagagaataagataatcaactctcaaataactaacactgttaatgatcactttgaatcaccctggcagacattttctttagataagtataggtttcaccgacgctaccaaaatattctgccctattaccttggtgtatctattttaaaggatctatctccgcagacaatagagtacgcgaagttgaaaaggccaagagttcaaaactatggttggaacttgtcaggaggccattacttaaagtataagggtgactttagaagccaagaaaaaaatataaggcatgagtctaaatttttcgactttgatgaccctgttcacttatccttaatcaataagttactaaggtattattttgatgagatcaatcctgttttcagtatcattcacgaagcgacattttggcagcaatataacaataaatttctacggcaaggtaaacaaaataattcatctgcgaatctattcacttccatgctttatctaattttgtctactacactaagattcagagaagggcatctagatggtcagaaagggcaaggaacctacagtaacacatccttaaatatcacattcgaggaaaaatctattttgatcaaaaaaccctccatagaggaaaatttattcaaatacgcttatttaataatcaacacgctgacctttgagtgggaatcattcgaactaatacaatcgtggcttttgataaccttctatttcagaacctgttacagacagacggcgtgctggaacgcgttaagtcaagcggtgaacatgtgtaatgggatgagtctatatttaaacaaatttcctgagatccattccacttatgatgaatcaaaagcatggcattgtttctggtgttgttttataatggataagttgataagttttcaaatgggtcgattctaccaactatcattacccgcgagcgagatgtgcgaacagatgaatctagtgaagtcaaagaaatttttacaagaagaagatgattggtttcacgaagagacttttcaaatgcttgatttgtccataatagtgacacagtttttaaaaagagacgcacaggatttaaatttgaacgagaccgtgcaattgcgcagccaacttggtcaatggtatgacacctttatagttggaagtcaaaccaatgcgtacgacgacaattatcgttacttctatcaagttcaaccattcatgacatacctggatataaggctgactttcgaagtaagacaattattttgtctaatcgccccctcatctaccgcaaataataaatccctagaatatgtcgtcgatactgaattgttaatttctcattgtcaaatggctattgaaaatttggctgaaattacgagaagtaatcttttctttgttccgtggtggttaaacctttctcaactattcacggtaaatttaatatgtattatctacctgcacgcagggattgccgtaactcaaaataaagctatcatgcaaagctgccaagaaatatggcgaaccttagagtgctctaagccaaaaaatcggccttcaatgcttcctgagtgcttgtggtgtttgaaaatgctgaatcatatgttctgcatacgactgagagattctgctttgcaattggaagctactctcggaactgatcatggtgatgacacccctaatagaaataagtttgagcagttcaagaaagttggcgataatgatgcggatgttgaagttgatgctggtgaaagagaagaaaatgctgatgaaagacaagaaaatccacataacaatagcaaaagagtaccattagctactaggtctcataataccactaacttcgacggttcaatcgcaatttctccggaaagtgcagtagcaaatctaggtactgatactggattgccctcagatgttcttgatactgtcagtaaaatagggaactctcctaatgtgtttgatgatgatttattttccaatttattatggtttgaccaaaattttgcataa

SEQ ID NO: 272 - DNA, 1914 bp, Saccharomyces cerevisiae
atgatcgaagtcccagaagacaatcgttctagccaaacaaagcgtaagaatactgaaaaaaattgtaatgaactgatggttgatgaaaagatggatgacgattcgtcgcccagagatgaaatgaaagataaattaaagggaacaaaatcattgattattcgtaagtctgagctaatggctaaaaagtatgatacttggcaattaaaagctatattcctgttttctgcattcatttgcactttcgcttatggattagatagcagcataaggggtacatatatgacctacgcaatgaactcgtactccgcacattctctcatttctacagtaagcgtcatagttctaatgatatctgctgtttcacaggtgatctttggagggttatcagatatctttggaaggctaacgttgtttcttgtatccattgtactttacattgtgggtacaataattcaatctcaagcatatgatgtccagaggtatgctgctggagctgtcttttattatgtgggacttgtcggtgttatgctacaggttgttttgatgttgtctgataattcttcattaaaatggaggctattttacacattgataccttcatggccctcgattatcactacgtgggtctcaggtagtgtagtggaggcagcaaacccgttagagaactggtcgtggaatattgctatgtgggcgttcattttccctctatgctgtatcccattgattttgtgtatgctccatatgagatggaaagtaagaaatgacgtggaatggaaagaattacaggatgaaaaatcgtactatcaaacgcacggattagtacaaatgctggtacagttgttctggaagctagatgttgtcggtgtgttgttgtttactgctggtgttggttgtattcttgtaccactcactcttgctggtggcgtctctacaaattggagaaattcaaagattatcgggccctttgtgcttggctttgtcctggttccaggcttcatatattgggaaagtcgacttgctttggttcctttcgctccattcaagctgctaaaagatcgtggcgtgtgggccccattgggaattatgttttttatctgctttgtatatcaaatggctgctgggtatctctacaccattctagtagttgcggtagatgagagcgcttcctcagctacaagaataataaacttatactcttttgtgactgctgttgttgctccatttctggggctcatcgttacgagatcatctagattgaagtcgtatattatttttggtggctcactttatttcattactatgggactattttaccgctacaggtcaggtcaagacgccgatggaggtataattgctggtatggttatttggggtctcagtagttgtttattcgattatcctacaattgtttctattcagtcggtaacatcccatgagaatatggctactgtcacagcattaaactatacagttttcagaataggtggagcagttgcagctgccatttccggtgccatatggacgcagtcattgtaccctaaattattgcactacatgggagacgctgacctggctacagcagcatatggctcaccactaacttttattctttccaatccctggggtactccagttaggtctgcgatggttgaagcttacagacacgttcaaaaatacgaagttattgttgcgcttgtattttcagcgcctatgttccttctaacattctgcgtaagagatcctcggttgactgaagattttgcccaaaagttacctgacagagaatatgtccaaaccaaggaagatgatcctatcaatgactggatcgcgaaacgttttgcaaaggccttaggaggtcataagaaagatttacaaaaccccaacaggatatgtgttcgaaaaaatgatctctga

SEQ ID NO: 273 - DNA, 2892 bp, Saccharomyces cerevisiae
atgacgagaaacccgtttatggtggaaccttcgaatggctctcctaatagacgtggtgcttcaaacctctccaaattttacgcaaacgctaacagcaactctcggtgggctaatcccagtgaggagagtttggaggatagctatgaccaatctaacgttttccaaggccttccggcatctccttcgagagctgcactaagatactccccagaccgtcgccatagaactcaattttaccgcgatagtgcccataactctccagttgctccgaacaggtatgctgctaatctacaagagtctcccaaaagagcaggcgaggctgtcatacatctaagtgaggggagtaacctttacccccgcgataatgcagatctaccggtagacccctaccatctatcaccccagcaacagcccagtaacaatctgtttggaagtggcagattgtattctcaaagctcgaaatacacgatgtctactacttccacaacggctccctctctggcagaagcagacgatgaaaaggaaaaatacctcacttcgactacttcctatgatgatcagtctacaattttctctgcagacactttcaatgaaacaaaatttgaactgaaccatccaacaagacagcagtatgtaagacgtgccaattctgagagtaagagaagaatggtctcagacttgcctcccccaagcaagaagaaggcactattgaaactagacaacccgataccaaaaggtctgttggatactttgcctcgtaggaactcccctgagtttacggaaatgagatatacagcctgcactgtggaacctgacgattttttgagagaaggttacactttgagattcgcagagatgaacagagaatgtcaaattgccatttgtattaccatgtacaatgaagataaatattcattggcaagaaccatccactccattatgaagaatgttgctcatctttgtaagcgtgaaaaatctcatgtttggggccccaatggctggaagaaagtctctgtaattctgattagtgacggtagagcaaaagtcaaccaagggtctctcgactatttagctgctttgggtgtttatcaagaagatatggccaaggcgtctgtgaatggtgatccggtaaaagcgcacatttttgaattgacaactcaggtctctatcaacgccgatctggattatgtttcaaaggacattgttcctgtgcaattggttttttgtctaaaagaagaaaataagaaaaagatcaattcccatcgttggctattcaacgcgttttgtcccgttttgcaacctactgtagttactttggttgatgtcggtacacgtttaaacaatacagcaatttacaggttatggaaggtttttgatatggattcaaatgtggctggtgcggctggtcagattaagactatgaaggggaagtggggactgaaacttttcaatccattagttgcatcgcaaaattttgaatataagatctcgaatattttagataaaccattagaaagtgtttttggttatatctctgttcttcctggtgccctgtccgcatataggtatagagccttaaaaaatcatgaagatggcactggccctctcagatcgtatttccttggtgaaactcaagaaggcagagaccatgatgttttcactgcaaatatgtacttggctgaagatagaattctttgttgggaattggtcgccaagcgagatgcaaaatgggttctaaaatatgttaaggaagccactggtgaaacggatgttcccgaagacgtttctgaatttatttctcaaagaagacgttggttaaatggtgcaatgtttgccgcaatttatgctcaattgcatttctaccaaatttggaaaactaaacattctgttgtacgcaagttctttcttcatgttgaattcctttatcaatttattcagatgcttttttcctggttttctattgcaaatttcgttcttaccttttattatttagcaggatcaatgaatttagttattaaacatggtgaggccttattcattttttttaaatacctgatcttttgtgacttggcaagtttattcattatttccatgggtaatagaccccagggcgcgaaacatttattcattacctccatggttatactgtctatatgtgccacatattctctaatttgtgggtttgtttttgctttcaagtcgttagcttctggaacggaatcccacaaaatatttgtcgacatcgttatctcattgctctccacctatggcctatactttttctcatcactgatgtacctagatccttggcacatgtttacatcatccatacaatactttttgacacttcccgcctttacgtgtactttacagatttttgccttctgtaatacacacgacgtttcctggggtactaaaggttccacacaggagtccaagcaattgtccaaggccattgtcgttcaaggtccagatgggaaacagattgtggaaacagattggcctcaggaagttgataagaagtttttggaaataaaaagtcgtttgaaagaaccagaatttgaagaatcaagcggcaatgaaaaacaatccaagaatgattattatagagatataagaaccagaattgtgatgatttggatgctatcaaatctaatactgatcatgtctataattcaagtctttacaccacaagatactgacaatggttatttgatattcattttatggtctgtggccgctttagctgcctttagggtggttggttccatggcctttttgttcatgaaatacttgcgtataatagtgagttacagaaataaagttgaaggtagcggctcatgggaagtctctaaattagacttaccaaatgttttccacaaaaagggctaa

SEQ ID NO: 274 - DNA, 1632 bp, Saccharomyces cerevisiae
atgatggactcgtcaagcaaaagcttaactcagtatataccctcacccatgggatctctatcaaggctaaagcagaagggtgtggacaattttcagaaggtgaaaaaatccggtaaatccatctataattacaactactcaaaattcgttcctcatccattttcaactattgatgaaagtgttaaacactctgaaagtgggcggtatgatgatttggagataattcgtccaacaaaagaaaaggaagtaacaagttctgtgtacaaaagaaacagtggcaagtctctgaatacagaatctcagttttcactgggagattcagatgcagccactttggtgaattcagtcgctactttcaagcttaacaatgcttctacatccacttcactggtgtcttcatcttcaactgtatgttctcaagcgaagtcctcgttacgttccccaacaagtcgtctcaatgatacaaaaatcaaagaggaaaacaattatatttccagcgtgaaagactattgcggtccaatgagaaaatccatggtaaagacggaaatcctcattgaagaacctttgaatcctactaccgatatcaagtcttttataaactcatacaaccatggcaaagcgtatagtctaggtgaaactcaacatttacattattatcagttgccattcccatggagggaaaacagatacataatccatggctataggttttacaatacccattccaaatctttgttgtctatctttaactggtacggctggcataatgaaacttcaaatatttggtctcatttgttaggagccatttatataatctacttggcaatttacgatttccctcagtctgaagtttggcggaattcccaggttccaccacaggctagatggattgttttcatgtttttggcagctgcgttgaaatgtatgctaagctccgtgttttggcatactttcaacggaacgtccttcttgaagctacgttctaaatttgcgtgtgtcgactatagcggtattacgatcttaattacagcttcgatattgacaacggagtttgttaccatgtattcatgttactgggcgatgtacacttacatgagtatttctctggcgctgggtgtatttggtgtgtttatgaattggtcgcctcgctttgatagacctgaagcaaggccattaagaattagattcttcattttgctggctactatgggtgtattgtcgtttttacatttgatatttttgactgatcttcattatgctgcaacgctatttagccccgtcacatacaaatctgttgtttggtatttggttggtgtggtattttacggttcgttcattcctgaacggttcagatctgacgttcaggttgataagaccattccaacaaactacgaattatctactgatttagaaatcatcacaaagcaaagggaaattcattttagagaggtgccaacagcccattccaaatgcagttcctgtccgtctcatgccaaatcatttaaatctctatggtgggttgactattttggttgttcgcacactttttggcatttcttcgtagtgttgggtgtcatcggccattatagagctattttagatatgtttgccaagaggtggattttgtcatga

SEQ ID NO: 275 - DNA, 3117 bp, Saccharomyces cerevisiae
atgaagcaaagaattagtgccctagatttactgctgttggctagagagctgaaacaggatttggaaggctaccgattgagtaatatatataacattgccgattcctcaaaacaatttttgctgaaatttaataaaccagattctaaactcaatgttgttgtcgattgtggcttaagaatttacttaactgaatttagtaggccaatacctccaactccttccggctttgttgtcaaactaaggaagcatcttaaagctaaacggttaacagctttaaagcaagtagaccaggatagaattcttgttctacaatttgctgatggccacttctatttagttttggaatttttcagtgcagggaatgtcattcttctagatgagaacagaagaattatggctttgcaaagagtcgttctagagcatgaaaataaggtcggacaaatttatgaaatgtttgacgaatcactttttaccacaaataacgagtctgctgatgaatccatagaaaaaaacagaaaggcagaatacacctctgaactagtcaacgagtggataaaagcagttcaagccaagtatgaatcagacattactgttattaagcaacttaacattcaagggaaggagggcgctaaaaaaaaaaaagtgaaagtaccttccatccataaactgctgctttcgaaagtccctcatttgtcttcagatttattatcaaagaaccttaaggtattcaatatcgacccttcagagtcttgtttaaatcttttggaggaaacagactcactcgccgaattgctaaacagtactcagttagaatataatcaacttttaactaccaccgatagaaagggttacattttggccaaaagaaatgaaaattatatctctgaaaaagatactgccgatttggaatttatttatgatacattccatccctttaagccatatataaatgggggagacactgactcttcttgtatcattgaagttgaaggtccttacaataggacgctagacaaatttttctcaacaatagaatcctctaagtatgctctacgtatacaaaatcaggaatcgcaagcgcaaaagaaaatcgatgatgctcgtgccgaaaatgatagaaaaatacaagctttattagacgtccaagaactaaatgaaaggaaaggccatctcataattgaaaatgcacccttaatagaggaagttaagcttgctgttcagggtctaatcgatcaacaaatggactggaacactattgagaaactaattaaaagtgaacaaaaaaaaggcaacagaattgctcagcttttgaacttgcctttgaacttgaaacagaacaaaattagcgtcaagcttgatctctctagcaaggaactcaacacttcttcagacgaggacaatgaatcagaaggcaatactactgatagttctagtgactcagactcagaagacatggagagttcgaaggagaggagtacaaaaagtatgaaaagaaaatctaatgaaaagataaacgttacaattgaccttggtttatcagcttatgccaatgccactgaatatttcaatatcaaaaaaacaagtgctcaaaagcagaaaaaagtcgaaaagaatgtcggcaaggctatgaagaatattgaagtcaaaattgatcaacaattgaaaaaaaagctaaaagattctcacagtgtcttaaaaaagatccgcactccttacttttttgaaaaatatagttggtttatttcaagtgaaggatttttggtcatgatgggtaaaagtccggctgagacagatcaaatctattcaaaatatattgaagatgatgatatttatatgtccaatagttttaactctcatgtatggatcaaaaatccagaaaaaacagaagttccaccgaacactttgatgcaagcgggtatactatgcatgtcctcaagcgaggcttggtcgaagaagatatcttcttctccatggtggtgctttgcaaagaatgttagtaaattcgatggctctgataactccattctgccagaaggtgcctttcggttgaaaaatgagaatgatcaaaaccatttaccccctgctcaacttgtgatgggttttggatttttatggaaagtgaaaaccagtggaaatgaggataatggtgatgatgacgaagaagaagaagaagaagaagaggaagaagaagaagaagaagaagaagaagaagaagaagaagaagaagaaaaagaagaagaagaaaaagaagaagagcaacagcaagatgaagacgatagtaacgaggtcaatgggttagagaagggtggagattcaaacgatagcacgaaaaacaacagttttgaacacgataatcttgaaaaagacatcgaaaagcattgcaccatatcatccgataccgactctgattctggaaatgctaaagccaaaaatgacaatagcagtacgcagcgtatccttgatgaaccaggtgttccgatatctttaatcgaaaacataaacagtaacgtccgtggtaaaagaggaaaattgaagaaaattcaaaagaaatacgccgaccaggatgaaactgaacgtctcttgcgtttggaggccttgggtactttgaagggtatcgaaaagcagcaacaaaggaagaaagaagaaataatgaagcgagaagttagagaagatagaaagaataaacgcgagaaacaaagaagactacaggctttaaaattcaccaaaaaagagaaagcaagagtgaactatgataaacacaagtccgaattaaaaccatctctcgataagggcgatgtggttgatgatattataccagtatttgccccctggcctgcgcttttgaaatataaatacaaagtcaaaatacaaccgggaagtgcgaagaaaactaagactttaactgaaattttacattatttcaagagtagaccactagacggttcttcaactgacaacgaaatggattggccccaagaacatgaaatgattaaaggcttgaaggaacaggacttggttcttctgctctgtgtcgacaagttaaaagtaacaatcgctgggcagaaatccaccaagaacggtggtaactcttcgaagaagggcaaaaaaaaacgctaa

SEQ ID NO: 276 - DNA, 2757 bp, Saccharomyces cerevisiae
atgactgatacatcatcctcttcatcatcctcttcagcatcttctgtttcagctcatcagccaactcaagaaaagcctgctaagacttacgatgacgctgcatctgaatcttctgacgatgacgatatcgatgctttaatcgaagaactacaatctaatcacggtgtcgacgacgaagacagtgataacgatggtccagttgccgccggtgaagctagaccagttccagaagaatatttacaaactgacccatcttacggtttaacttccgatgaagttttgaaaagaagaaagaagtacggtttgaatcaaatggctgacgaaaaagaatctttagtcgttaagttcgttatgtttttcgtcggtccaattcaattcgttatggaagccgctgctattttggctgccggtttgtccgattgggtcgatttcggtgttatctgtggtttgttaatgttaaacgctggtgttggtttcgttcaagaattccaagctggttctattgtcgatgaattgaaaaagactttggctaacactgctgttgttatcagagacggtcaattggttgaaattccagccaacgaagtcgtcccaggtgatattttgcaattggaagatggtactgttatcccaactgatggtcgtattgtcactgaagactgtttcttgcaaatcgatcaatctgctattactggtgaatctttggctgtcgacaaacattacggtgaccaaactttctcttcttccactgttaagagaggtgaaggtttcatggttgttaccgctaccggtgacaacactttcgttggtagagctgctgctttggttaacaaagccgctggtggtcaaggtcatttcactgaagttttgaacggtattggtattatcttattggttttggtcattgccactttgttgttggtctggactgcttgtttctacagaaccaacggtattgttagaatcttgagatacactctaggtattactattattggtgtcccagtcggtttgccagctgtcgttaccaccactatggccgtcggtgctgcttacttggctaagaaacaagccattgttcaaaagttgtctgctattgaatccttggctggtgtcgaaatcttgtgttccgacaaaaccggtactttgaccaagaacaagttgtccttgcacgaaccatacactgttgaaggtgtttctccagacgacttgatgttgactgcttgtttggctgcttccagaaagaagaagggtttggatgctattgataaggctttcttgaagtctttgaagcaatatccaaaggctaaggacgctttgaccaagtacaaggttttggaattccatccatttgaccctgtctccaagaaggttactgccgttgtcgaatctccagaaggtgaaagaattgtttgtgttaagggtgctccattattcgtcttgaagactgtcgaagaagatcacccaatcccagaagatgtccatgaaaactacgaaaacaaggttgctgaattggcttctagagggttccgtgctttaggtgttgctagaaagagaggtgaaggtcactgggaaatcttgggtgttatgccatgtatggatccaccaagagacgatactgctcaaactgttagcgaagctagacacttgggtctaagagttaagatgttaactggtgatgctgttggtattgctaaggaaacttgtagacaattgggtttgggtaccaacatttacaacgctgaaagattaggtctaggtggcggtggtgacatgccaggttctgaattagctgattttgttgaaaatgccgatggtttcgctgaagttttcccacaacataaatacagagttgttgaaatcttgcaaaacagaggttacttggttgctatgactggtgatggtgttaacgatgctccatctttgaagaaggctgatactggtattgctgtcgaaggtgctactgatgctgccagatctgctgctgatattgttttcttggctcctggtctatctgctattattgatgctttgaagacctccagacaaatttttcacagaatgtactcttacgttgtttaccgtattgctttgtctctacatttggaaatcttcttgggtctatggattgctattttggataactctttggacattgatttgattgttttcatcgctattttcgctgatgttgctactttggctattgcttacgataatgctccttactctccaaagcccgttaaatggaacctaccaagattatggggtatgtctattattttgggcatagttttagctataggttcttggattaccttgactactatgttcttaccaaagggtggtattatccaaaacttcggtgctatgaacggtattatgttcttgcaaatttccttgactgaaaactggttgattttcattaccagagctgctggtccattctggtcttctatcccatcctggcaattggctggtgccgtcttcgctgtcgacatcatcgctaccatgtttaccttattcggttggtggtctgaaaactggactgatattgttactgtcgtccgtgtctggatctggtctatcggtatcttctgtgttttgggtggtttctactacgaaatgtccacttctgaagcctttgacagattgatgaacggtaagccaatgaaggaaaagaagtctaccagaagtgtcgaagacttcatggctgctatgcaaagagtctctactcaacacgaaaaggaaacctaa

SEQ ID NO: 277 - DNA, 1404 bp, Saccharomyces cerevisiae
atggctccatttaggcaggacagtattttgataatataccccagatctcaaactactctcgttcaatttggtttgaatgaagaaacattcactgtacctgagctggaaataccaacacagatttatcggaccacgagacaagatggttcctacacatatcattcaacgaacaaggataataaagccgaattaatcaaaccaatccaaaatggtgaaataatagacataagcgcctttacacaatttcttagactaatatttgtatctattttgtctgatagagctaataaaaatcaagatgcttttgaagctgaattatctaatattcctcttctactgattacgcaccactcttggtcgcaatcggatctagagattattactcaatatgtcttcgaaagtcttgagataaacaatctaatccaattgccggcttccttagcggccacttattctatgatttcgttgcagaattgttgtattattgatgttggaacacatcatacagatattattcctattgttgactatgcacaattagaccatcttgtctcttcaataccaatgggcggacagtctattaatgattctctaaaaaaactactacctcaatgggacgatgatcagatagaatcattgaaaaaatcaccaatttttgaggtgctcagtgacgacgccaaaaaactatcaagtttcgattttggaaacgaaaatgaggacgaggatgaaggaactttaaacgttgccgagattattacaagtggtcgtgatacacgtgaagttttagaggaaagagaacgtggtcaaaaagtcaaaaatgttaaaaatagcgacttggaattcaatactttttgggatgaaaaaggtaacgaaattaaagttggtaagcaaagattccaaggatgtaataacctgattaagaatatttctaatcgtgtaggattgacgttagataacatagatgatattaacaaagctaaagccgtttgggaaaatattatcatcgtcggtggcactacttcaatttcaggttttaaagaagctttactgggtcaactactgaaagaccatttaattatagagccagaggaagagaagtcaaaaagagaagaggaagcgaaatccgtattaccagctgcaacaaaaaagaaaagcaagtttatgacaaatagcaccgcatttgttccaactatagaatacgtacagtgtcctacagtaatcaaactggctaaatatccagattactttcctgagtggaagaaaagtggatattcagagattatattcttgggtgcccaaattgtttctaagcaaattttcactcatcctaaagatacattttatatcacaagagaaaagtataatatgaaaggaccggctgctctttgggacgtgcaattttaa

SEQ ID NO: 278 - DNA, 2052 bp, Saccharomyces cerevisiae
atgacaatcaaggaacataaagtagtttatgaagctcacaacgtaaaggctcttaaggctcctcaacatttttacaacagccaacccggcaagggttacgttactgatatgcaacattatcaagaaatgtatcaacaatctatcaatgagccagaaaaattctttgataagatggctaaggaatacttgcattgggatgctccatacaccaaagttcaatctggttcattgaacaatggtgatgttgcatggtttttgaacggtaaattgaatgcatcatacaattgtgttgacagacatgcctttgctaatcccgacaagccagctttgatctatgaagctgatgacgaatccgacaacaaaatcatcacatttggtgaattactcagaaaagtttcccaaatcgctggtgtcttaaaaagctggggcgttaagaaaggtgacacagtggctatctatttgccaatgattccagaagcggtcattgctatgttggctgtggctcgtattggtgctattcactctgttgtctttgctgggttctccgctggttcgttgaaagatcgtgtcgttgacgctaattctaaagtggtcatcacttgtgatgaaggtaaaagaggtggtaagaccatcaacactaaaaaaattgttgacgaaggtttgaacggagtcgatttggtttcccgtatcttggttttccaaagaactggtactgaaggtattccaatgaaggccggtagagattactggtggcatgaggaggccgctaagcagagaacttacctacctcctgtttcatgtgacgctgaagatcctctatttttattatacacttccggttccactggttctccaaagggtgtcgttcacactacaggtggttatttattaggtgccgctttaacaactagatacgtttttgatattcacccagaagatgttctcttcactgccggtgacgtcggctggatcacgggtcacacctatgctctatatggtccattaaccttgggtaccgcctcaataattttcgaatccactcctgcctacccagattatggtagatattggagaattatccaacgtcacaaggctacccatttctatgtggctccaactgctttaagattaatcaaacgtgtaggtgaagccgaaattgccaaatatgacacttcctcattacgtgtcttgggttccgtcggtgaaccaatctctccagacttatgggaatggtatcatgaaaaagtgggtaacaaaaactgtgtcatttgtgacactatgtggcaaacagagtctggttctcatttaattgctcctttggcaggtgctgtcccaacaaaacctggttctgctaccgtgccattctttggtattaacgcttgtatcattgaccctgttacaggtgtggaattagaaggtaatgatgtcgaaggtgtccttgccgttaaatcaccatggccatcaatggctagatctgtttggaaccaccacgaccgttacatggatacttacttgaaaccttatcctggtcactatttcacaggtgatggtgctggtagagatcatgatggttactactggatcaggggtagagttgacgacgttgtaaatgtttccggtcatagattatccacatcagaaattgaagcatctatctcaaatcacgaaaacgtctcggaagctgctgttgtcggtattccagatgaattgaccggtcaaaccgtcgttgcatatgtttccctaaaagatggttatctacaaaacaacgctactgaaggtgatgcagaacacatcacaccagataatttacgtagagaattgatcttacaagttaggggtgagattggtcctttcgcctcaccaaaaaccattattctagttagagatctaccaagaacaaggtcaggaaagattatgagaagagttctaagaaaggttgcttctaacgaagccgaacagctaggtgacctaactactttggccaacccagaagttgtacctgccatcatttctgctgtagagaaccaatttttctctcaaaaaaagaaataa

SEQ ID NO: 279 - DNA, 1752 bp, Saccharomyces cerevisiae
atggatgaatttgaatctaccaaactttcgaaggttcagttttccactagcgtgttaagtacgccttcgaatgaaggaaataatctaatacacagattcaagaactctttcaagcgaaatgattcaccagcgatccaagaaggtttgctgtattcggagctttcagaggaagaaaaaatacaatgggacttagccaaccagccgtataaaaaggtcctagatcaaagacacctgaccatgatagccattggaggtactctagggacgggtcttttcattggtttaggggaatcactagcgtccggacctgcttctttgctaattggtttcttgttggtcggcgcatctatgctctgtgttgttcagtgtggggccgaactttcatgtcagtaccctgtttccggctcctatgcgctgcacgccagtagatttatagacccatcagtcggcttcagtataggaattaactacttattgatgtggctcatatcttaccctagcgagctggtaggatgttcgcttaccatctcttattgggcaccatcggtcaatcctgctgcctgggttgcaatcgcgttcgttttaagcatgctattgaatctttttggggcaagaggctttgcagaatcagagttttatatgtcaattttcaaaattgtggctctattcatttttataattattggtattgttctcattgcaggtggtgggcctgattctactggatacatcggcacgaagtattggcacgatccaggctccttcgctgttcctgttttcaaaaacctctgcaatacttttgtttcggcagcatactcctttagtggtacagaaatggttgttttaaccagcactgaagcaaggagtgtttcctcagtctctcgggcagcgaaaggtacgttctggagaattatcatcttttatattgttacagtgattataattggttgcctggtcccttataatgatcctcgtctgattagcggttcatccagtgaggatattactgcttccccgtttgttattgccttgagcaatactggtgctatgggaacaagagtgtctcattttatgaatgcggtcatcttgatagccgtattttctgtttgcaattcctgcgtttacgcatcctctagattgattcagggtttggcgacagcaggccaacttccaaagatctgcgcttacatggacaggaatggtcggcctttagttggcatggctatatgtggcgcttttggattgttaggctttttggttgtttccaagaaccagggtacagttttcacatggttgtttgcgttgtgttccatttcatttttcacaacttggttctgtatttgcttctgtcaagtcagatttaggatggcaatgaaagctcaaggaaggtcaaaggatgacattatctatagatcgacattagggatatacggaggaattttcggctgtatcttaaatgttctattggtaattggagaaatatatgtatcggctgcacccgtgggtagtcccagttctgctgctaatttctttgaatattgtatgagtattcccataatgattgctgtatatattggccatagaatttaccgcagagactggagacactggtacatcaagcggatggatattgacctcgatagcggacattcgttagaggacttcgaagccaccaagcttgagagggatgaggataagaaatacgtttcctctaagccactttactataggatctatcggtttttctgttaa

SEQ ID NO: 280 - DNA, 3396 bp, Saccharomyces cerevisiae
atgagtgatcaaaataatcgatcgagaaatgaatatcactcaaaccggaagaatgaaccttcctatgaactccaaaatgcacatagcgggctatttcactcttctaatgaagaattaacaaacaggaaccaaagatataccaatcaaaatgccagcatgggttcattcactccagtccaatctttgcaatttccagaacaatctcagcaaacaaatatgctttataacggtgacgatggcaataataatactatcaatgataacgaacgagacatatatggaggttttgtcaaccaccatcgccagcgtcccccaccagcaactgcagaatacaatgacgtttttaatacgaatagtcaacagctaccgtcggaacatcaatacaataacgtaccttcatatccacttccttcgataaatgtgattcaaaccactccagaactcatacataacggctcacagactatggccacccccatcgaaaggcccttctttaacgaaaacgactactattataataacaggaactctaggacgtcaccgagtattgcttctagtagcgatggttatgcagatcaggaagctaggcccattttggagcaacccaacaataacatgaatagcggtaatattcctcaataccatgaccaaccttttggatacaacaatggttaccatggcctacaggcaaaagattactatgacgatccggagggtggttatattgatcagagaggagatgactatcagattaattcatatttgggtagaaacggtgaaatggttgatccttacgattatgaaaacagtttaagacatatgactcctatggagcgtagagaatatcttcatgatgatagcagacccgtaaacgatggaaaagaagaattagacagtgtgaaaagcggttactctcatagagacttgggggaatatgacaaggatgatttttcaagggatgacgagtacgatgatctcaacactattgataaattacagtttcaagctaatggtgtacctgcatcatcctcggtgtcttctatcggatctaaagaatccgacataatagtaagcaatgataacttaaccgcaaatagagcactaaagagaagcggtactgaaattaggaaattcaaactttggaatggtaattttgttttcgattctccaatcagtaagacgctattggaccaatacgctactacaacagaaaatgcaaacactttaccaaatgagtttaagtttatgagatatcaagcagttacttgcgaacctaatcaacttgcagagaagaatttcacggtgaggcagttgaagtatttaactccaagggaaacggaattgatgctagtagtcacaatgtataatgaagaccatatcctgttaggaagaactttgaaaggtattatggacaatgtcaaatatatggtgaaaaaaaaaaattcaagcacttgggggccggatgcatggaaaaagattgtcgtttgtatcatttcagatggtagatccaaaattaatgaacgctcgctagcattactaagttcgttaggttgttaccaggacgggtttgctaaggatgaaattaatgaaaaaaaagtggcaatgcatgtctacgaacatacgacaatgatcaacatcacaaatatttcggaatcagaggtttcattagaatgcaatcaaggtaccgttccaatacaacttttgttttgtttgaaagagcaaaatcagaaaaaaattaactcacatagatgggcatttgaaggctttgcagaattactgcgtcccaatatcgttacattgttagatgctggtaccatgccaggtaaagattctatttaccagttatggagagagttcaggaatccaaatgttggtggcgcatgtggtgaaataagaactgatttgggtaagagatttgtaaagcttttgaatcctttagttgcatcacagaatttcgaatacaaaatgtccaatattttagacaaaacaaccgagtctaactttggatttattactgttctaccgggggcattctctgcgtataggtttgaagctgtgagaggccaaccattacagaagtacttttatggtgaaattatggaaaatgaaggttttcattttttttcttccaatatgtatcttgctgaagatcgtattttatgctttgaagtggtcacaaaaaaaaattgtaattggattttgaaatactgcagaagttcttatgcttcaacagatgtaccggagagggtccctgaatttattcttcagaggaggcgttggttgaatggttcattttttgctagtgtatattccttttgtcatttttacagagtctggagcagtggtcataatattggtagaaaactccttttgacggttgaatttttttaccttttcttcaatacattgatttcatggttttcattgagttcatttttcctattctttagaattctcactgtttctattgcactggcataccattcagcatttaatgtgttgtccgtcatattcctgtggctttatgggatttgtaccttatcaacattcatactgtcattgggtaataaacctaaaagtactgagaaattttatgttctaacttgcgtcatttttgcggtgatgatgatttacatgatattctgcagtatattcatgagtgtcaaatccttccaaaatatattgaaaaacgataccatcagctttgagggtttgattaccacagaagctttcagggatattgttatctctctgggctccacttattgtttgtacctaatcagttcaattatctatttgcagccatggcatatgttgacaagttttattcagtatattttattgagtccttcttacatcaatgttttgaatatctatgcattttgtaatgtccacgacttatcatggggtacaaagggtgcaatggcaaatccgctgggtaagattaatactacagaagatggtacgttcaaaatggaagttctggtctctagttcagagattcaagcaaactacgataaatatttgaaagttttaaatgacttcgatccaaaatcagaatctcggcctactgagccatcttatgatgaaaaaaagactggctattatgcaaacgttagatctctcgtgattatcttttgggtcatcacaaatttcatcatcgttgctgttgtcttagaaaccggtgggattgcagattatattgctatgaaatccatatcaactgatgacactttagaaactgcaaagaaggcggaaattcccttaatgaccagtaaggcctcaatttattttaatgtaattttatggttagttgcattatcggcattaataaggttcattggttgctcaatatacatgatagtaaggttttttaaaaaggttacatttcgctaa

SEQ ID NO: 281 - DNA, 1674 bp, Saccharomyces cerevisiae
atgaaggttgattacgagcaattgtgcaaactctacgatgacacgtgccgcacaaagaatgtgcagttcagttacggtacggccggattcagaacgctggccaagaatttggatacggtgatgttcagtactggtatactggcggttctcaggtcgctgaagcttcagggtcagtatgtgggggtgatgatcacggcgtcgcacaacccataccaggacaacggggtcaagatcgtggaaccagacggatcgatgcttttggccacatgggagccatatgccatgcagttggccaatgcggcctcttttgccactaattttgaagaatttcgtgttgagttggccaagctgattgaacacgaaaagattgatttgaatacaaccgtcgtgcctcacatcgtggttgggagagactctagggaaagtagtccatacttgctgcgctgcttgacttcctccatggccagcgtcttccacgcgcaagttttggacctaggctgtgtcactacgcctcaattgcattacattactgatttgtccaacaggcggaaactggaaggagacacagcgccagttgccacagaacaggactactattcgttctttataggagccttcaacgagctcttcgccacgtatcagctggagaagaggctgtctgtcccaaaattgttcatagacacagccaatggtatcggtggtccacagttgaaaaaactactggcctccgaagattgggacgtgccagcggagcaagttgaggtaatcaacgacaggtccgatgttccagaactgttgaattttgaatgcggtgcggattatgtgaagactaaccagagattacccaagggtctttctccatcctcgtttgattcgctatattgctcctttgatggtgacgcagacagggttgtgttctactatgtcgactcaggatcaaaatttcatttgttggatggtgacaaaatttccactttgtttgcaaagttcttgtctaaacaactagaattggcacacctagaacattctttgaagattggtgttgtgcaaactgcctatgcaaacggcagttccaccgcttacataaaaaatacgttgcactgtcccgtgtcttgcactaagacaggtgttaaacacttgcatcatgaagctgccactcagtacgatattggcatttatttcgaagcaaatggacatggtacgattatattcagcgaaaaatttcatcgaactatcaaatctgaattatccaagtccaagttaaatggtgatacgttagctttgagaactttgaagtgtttctctgaattgattaatcagaccgtgggagatgctatttcagacatgcttgctgtccttgctactttggcgattttgaaaatgtcgccaatggattgggatgaagagtatactgatttgcccaacaagctggttaagtgcatcgttcctgataggtcaattttccaaaccacggaccaggaaagaaaattgctcaatccagtggggttgcaagacaagatagatcttgtggtagccaagtatcccatgggaagaagctttgtcagagccagtggtacggaggatgcggtgagggtttatgcggaatgtaaggactcctctaagttaggtcaattttgtgacgaagtggtggagcacgttaaggcatctgcttga

SEQ ID NO: 282 - DNA, 1185 bp, Saccharomyces cerevisiae
atgtggacaaacactttcaaatggtgcagcaaaactgagaaggagaccactactgcagacgccaaggtgtgtgctagcgtgcagggcctgaaggccctgcagcagcaaattatggatagcaccactgtgcgtgggtccgttaataacacgatgactccaggcgggattaaccagtggcatttccacaataagcgtgcgaacaaagtgtgcacgcctacagtactaatccatggatacgctgcctcgtcgatggcgttctacaggacgtttgagaacctgtcagacaacattaaagatctatatgccatcgacttgccagccaatggtgcctcagaggcgccagcattgcaagtgaacaaaaccaagaagatcaagtctctcaggtttaagcatatagaagatgacgtagtaatccctgtgatagagaagcgccccccagcagaggacatcaagtcacacctggagcagtacgaaagctacttcgtagacaggatagagcaatggcggaaggataacaagcttcgcaaaataaacgtggtgggccattcattcggaggatatatttcattcaaatacgccctcaagtaccctgattccattgagaaactgtgtctcatatctcctcttggtgtggaaaacagtatacatgctatcacccacaaatgggagcccaacaccacctatccacttacgtttaccgacccatcgtcccgatattatacaagaaagctgaacgtaccgcggtttatctttgaaaaccagctaaacgttttgaagtggatgggacccataggctccaaattgtgctcgaactacatctccaccgcatacgtaaaagttccggatcagatatataaggactatcttttgcactcatttgtcgggaagaaccagacggtgcaaccacagacaatcaaggtgttcacccatttgtttgaaaggaatctgatcgctagagatccgataataaacaacgttcgttttttgaacccagcaacgcctgtcatgttcatgtatggcgagcacgattggatggataaatatgcgggctacttgactactgaatcaatgctaaaaaacaaggcaaaggctagctacgttgaagtccctgatgctggccataatcttttcctggacaacccgcagcactttgcctcttctttagtctcgttcctgtcaaagtaa

SEQ ID NO: 283 - DNA, 987 bp, Saccharomyces cerevisiae
atggaaaaaaaacatgtcactgtgcaaatacaaagtgctcccccctcctatatcaaattggaagcaaatgaaaaattcgtatatattacaagtacaatgaacggcttatcttatcaaattgcggctatagtttcatacccagaaaagagaaattcatcaactgcaaataaagaagatggtaaattactgtgcaaggaaaataaactagcattgttactacacggaagtcaatctcacaagaacgctatttatcaaactttactagcaaaaaggctggccgaattcggatattgggtactaagaatagattttaggggccaaggtgattcctcagataactgcgaccctggccttggtaggacgctcgctcaggatcttgaagatttgagtacagtataccaaacagtatctgacaggtctcttagggtgcaattgtacaaaactagtacaatatcactggacgtggttgtggcacattctagaggatctcttgccatgttcaaattctgtctaaaattacatgcagctgaatctccattaccgtctcacctgatcaattgcgctggaagatatgatgggagaggacttattgaacgctgcacacgactgcacccgcattggcaagcagaaggtgggttttgggcgaatggtccacgaaatggcgaatacaaagacttttggataccattaagtgagacttatagtatcgctggcgtttgcgttccggaatttgccacgataccacaaacttgttcagtaatgtcctgctatggcatgtgtgatcacatagtgccaattagcgcagcctcaaattatgcaaggcttttcgagggcagacattcattgaaacttattgaaaatgcggaccacaattattatggcattgaaggtgatcccaacgcgctaggcttaccgataaggaggggtagagtcaactactcaccactagtagttgatctaattatggaatacctgcaagatacatag

SEQ ID NO: 284 - DNA, 1368 bp, Saccharomyces cerevisiae
atgtcagaagaggataaagcgaaaaaattagagaatttattgaagttattacagttgaataatgacgatacttcaaaattcactcaagaacagaaaaaagctatgaaagaccacaaattctggagaacgcaaccggtcaaagatttcgatgaaaaggtggtggaagaaggccccattgataagccaaagacaccggaagatatatctgacaagccactacctttattgtctagcttcgaatggtgtagtattgatgtggacaacaaaaaacagcttgaagatgttttcgttctactaaatgaaaactacgtggaagaccgcgatgcaggcttcagatttaactataccaaagaattcttcaattgggctttaaagagtccaggttggaagaaggattggcatattggtgttcgcgttaaagaaacacagaaattagttgcctttatctcagccataccagtaacacttggtgttagaggtaaacaagtgcctagtgtagaaatcaatttcttgtgcgttcacaaacagctaagatcgaagagattaacacctgttctaattaaagaaattacgagacgagtgaacaaatgtgacatctggcatgcattgtacacggcaggtattgttttgccagcacctgtgagtacgtgtcgttatactcatcgtcccttgaattggaagaaactttatgaagtagatttcacagggttaccagatgggcacacagaggaggatatgattgctgagaatgcgttaccggccaaaacaaagacagcgggattgagaaaattaaagaaggaagatattgaccaagtttttgagttgttcaaaagatatcaatccaggttcgaactaattcaaattttcacaaaagaagaattcgaacataatttcattggtgaagaatcgttaccattggataaacaagtaattttctcatatgtagtcgaacagcccgatggaaaaattacagacttcttctcattttactcattgccattcacaatcctaaataacacaaaatataaggacctaggcatcgggtacttgtattattatgccaccgatgcagatttccaattcaaagacaggtttgatccaaaagctactaaggctttgaaaacaagattgtgtgaattgatttatgacgcttgtattttggccaaaaacgctaatatggatgtttttaacgcgttgacttcgcaagataatacattgttcttggatgatttgaagttcgggcccggtgacgggttcttgaacttctatttatttaattatagagcaaagccgattaccggtggcttgaatcccgacaatagtaacgacattaaaaggcgtagcaatgtcggtgttgttatgttgtag

SEQ ID NO: 285 - DNA, 1929 bp, Saccharomyces cerevisiae
atgtcaaaagctgtcggtattgatttaggtacaacatactcgtgtgttgctcactttgctaatgatcgtgtggacattattgccaacgatcaaggtaacagaaccactccatcttttgtcgctttcactgacactgaaagattgattggtgatgctgctaagaatcaagctgctatgaatccttcgaataccgttttcgacgctaagcgtttgatcggtagaaacttcaacgacccagaagtgcaggctgacatgaagcacttcccattcaagttgatcgatgttgacggtaagcctcaaattcaagttgaatttaagggtgaaaccaagaactttaccccagaacaaatctcctccatggtcttgggtaagatgaaggaaactgccgaatcttacttgggagccaaggtcaatgacgctgtcgtcactgtcccagcttacttcaacgattctcaaagacaagctaccaaggatgctggtaccattgctggtttgaatgtcttgcgtattattaacgaacctaccgccgctgccattgcttacggtttggacaagaagggtaaggaagaacacgtcttgattttcgacttgggtggtggtactttcgatgtctctttgttgttcattgaagacggtatctttgaagttaaggccaccgctggtgacacccatttgggtggtgaagattttgacaacagattggtcaaccacttcatccaagaattcaagagaaagaacaagaaggacttgtctaccaaccaaagagctttgagaagattaagaaccgcttgtgaaagagccaagagaactttgtcttcctccgctcaaacttccgttgaaattgactctttgttcgaaggtatcgatttctacacttccatcaccagagccagattcgaagaattgtgtgctgacttgttcagatctactttggacccagttgaaaaggtcttgagagatgctaaattggacaaatctcaagtcgatgaaattgtcttggtcggtggttctaccagaattccaaaggtccaaaaattggtcactgactacttcaacggtaaggaaccaaacagatctatcaacccagatgaagctgttgcttacggtgctgctgttcaagctgctattttgactggtgacgaatcttccaagactcaagatctattgttgttggatgtcgctccattatccttgggtattgaaactgctggtggtgtcatgaccaagttgattccaagaaactctaccatttcaacaaagaagttcgagatcttttccacttatgctgataaccaaccaggtgtcttgattcaagtctttgaaggtgaaagagccaagactaaggacaacaacttgttgggtaagttcgaattgagtggtattccaccagctccaagaggtgtcccacaaattgaagtcactttcgatgtcgactctaacggtattttgaatgtttccgccgtcgaaaagggtactggtaagtctaacaagatcactattaccaacgacaagggtagattgtccaaggaagatatcgaaaagatggttgctgaagccgaaaaattcaaggaagaagatgaaaaggaatctcaaagaattgcttccaagaaccaattggaatccattgcttactctttgaagaacaccatttctgaagctggtgacaaattggaacaagctgacaaggacaccgtcaccaagaaggctgaagagactatttcttggttagacagcaacaccactgccagcaaggaagaattcgatgacaagttgaaggagttgcaagacattgccaacccaatcatgtctaagttgtaccaagctggtggtgctccaggtggcgctgcaggtggtgctccaggcggtttcccaggtggtgctcctccagctccagaggctgaaggtccaaccgttgaagaagttgattaa

SEQ ID NO: 286 - DNA, 2067 bp, Saccharomyces cerevisiae
atgggggaaaaaaggacaataatcaaagcgctgaaaaactctgcagcgtcccacttcatcaagaagttgaccgcagatacttccctgtcgtccatacaagaggcaataaacgtcgtgcagcagtacaatgcaacggatcccgtgagattaaagcttttccatacgcctcggatggtttcgcagggggctcattttgcattttgtttgcccactaagaaaccacattacaagccattactgctttcgcaaaacgcacttgatgagtttaatttggtgcaggatcaggacttggagaaaatactatccggtgagaaagtatattattccgatagtatctttccctatagtacagtgtactccggatttcaattcggctcatttgctgcacagctgggagacggacgtgtggtaaacttgtttgatcttaaggacaagtgtagcggacaatggcaaacgtttcagttgaaaggtgccggtatgacgccattttctcggtttgcagatgggaaagctgtgttaagatcaagcatacgtgaattcataatgagcgaggcgttgcacagtattggaattccatccacaagagctatgcaattaactctgttaccggggacgaaggcgcaaaggcgcaatcaagaaccgtgcgctgttgtatgccgttttgcgcccagctggatccgcttgggtaacttcaacctattcagatggcggcacgacttgaaagggttgatccaactatcagattattgcattgaggaattgtttgctggggggacccaatttgaggggaaacccgactttaatatattcaaaagggatttttttcctgacactgagacgaagattgatgagcaggtggaaaaggatgaaactgaggtgagtaccatgaccggagataacatttccacattgagcaaatatgatgagtttttcagacatgtagttagcttgaatgcaaacacagtggcccattggcaagcgtatgggtttgctaacggtgttttgaatacggataacacctccattatgggcctgacaattgattatggcccctttgccttcctggacaagtttgaaccaagctttaccccgaaccatgatgacacagcgaagagatattcgtttgccaaccagccaagcattatatggtggaacttgcaacagtttgccaaggatctcgcatgtctgctgggtcctgaggcccgtgaccttgaattgttacttaagggcgaactgaattctgttgatgacgccctagagaaaaccatgattgaaagggtccagaagttggtagagctcagtgctaatgagtacaagtatgtgtttacgacaaggtacgcgcagataatgtctcaaagactcggtgtagatctggatctggaaaagtgcatgtcttctacaaacctcaaagatatcgaacatgcagccgagaaggctaaagagttctgcgatgttatcgtcgaaccattgctagatattctgcaggccacaaaagtcgactataacaatttttttatccatctacaaaattacaaggggcccttcttcatcaaagataaaagtgacaccgcaacactttttggagcattcgatgaagagtacttgggtatgttcttcaactccaagcaactgcagcaaatggcagaaactgaagaggccttcgcggctggtgagaaggtctttgacgctaacggcgaattgcgtttgctcaacgaaaaattgcaagaaatacgcaattggacccaagactatttgaccttggtcccacccacggaaactgctgcaagagcgtcgcttgccaagaaagccaacccgttgtttgtccccagaagttgggtactggaggaagtagtcgacgatttaatgtacagtcaaagggatggcctacaagatcccagttcggagctagatacatctgcgttgaagaagctatacctaatgagcgtaaacccatacgaccgcacgaaatgggatgtcactctgcggccagaactggagacaaaatgggctgacctttcccaccaagatgacgctaagtttatgatgcaagcttcctgcagtagctaa

SEQ ID NO: 287 - DNA, 2643 bp, Saccharomyces cerevisiae
atggatgcgttgactcccagggactcccccaagcgcgatgactcgatggccacgagtgcggccactgctgcttctgccaagcctgatgctctgacgataggtaaagaaggcattgtccacgggcacatccataactacaacaacctgacctatatccatggtcaccttcaccacagcgcgcctgtgaacgacagtagtgcttcggcaacacctgcagccgcagctgttgctgatgccgctacttccgcatttgcatctggagctagccatgatatgggtggtgattgccacgtcaatgagaaatgcaaggagtacaccgactgccaacatttcgagttcttgaattatcacaataatccgtcattaacaaaatataatgatactgcaacgtataattctaataatcattcttttgcaaacaatttccattcggtagcttctgatccgacaagtccccaacagaattctaaaagcgacctaccacgtagaaaagattcttggtttaacgacgatctgatactgctgccctcttccaagaaaaataaaccgaacccaccacctggatccgatgattgttattgtacgcccaagattttggaaatatgttgtgacgaaactcatcccaaaagtgaggctaatataaaacaaggtgaatctgatcaaccgacaaagaaagacatatctgagaacggcaatgatgttgcaatattcacagatgtaaagaacgatcacttgatgccaaattttaaccttcatgatcagtactgtaatagtaccaatcacgactctcacaatcacaataatactgtaccagatagcttttctcagctgatgtctcacttatcggagattgattgcgatttgacctgtgacaccccatgcacggctagcacgagcgcgactagtggtcacaagtttgttcaagatcatcaatcatcaaataatgatgacgttttccataaatactgcaaattttgtgaggagagcactgataatcaaccttgttctaagcatatgcatttagagtcaaagccacctcaactaccacccaaatgttcatctttacgaaaacctacaaacactttgcaaggtacaaatcatgcttatcacgaacatatcttaaatactgatatggatttgaagattttggaagatttatgcaatatttcttctttgtatgaagtaccgtttggaaaacacattaaccaccacgaccacaataatgccggtaacggctgcgatggttcgagcacaggaaataatgaaaacggtaaccaaacaatgaatcttctattatcaagcattaatagatgcaaccctaaaaataatcttaatggaagcaataacaatacggctggagcaacttcaactgatcatcaacaccatcaccatagaatacagtttcattctcacaaaccaaatagaaacaatattgtgaacaattcagggattagcgcggcgaacacaacagccgatctaactaacaacgatttaaatgacttaatttcaagagagtatagttatgaaagatttagaaatcaaagtgagcccccttcgctacccaaagtcactcatcagaatcagaaaaatcgtagatcttggcctacaaaagatctagaatctactgatttcagctctttggaagactcattaccttctagcatctctcctcctatacagacaacaagcactataaatttcaactggtgttttaaagaagagaaaaacaatgacttaaaatgcaaatggaaagaatgtcctgagtcttgtagctcactatttgacctacaaagacatcttttgaaggatcatgtctctcaagatttcaaacaccctatggaaccattagcttgtaattgggaggactgtgatttccttggagatgatacatgttccatagtgaaccatattaattgtcaacatggtatcaattttgatattcaatttgccaacccagactcatttttgcctggtagtatatcaaaggaaaaacatcacttactacattgccccaacccacaaacacacgaagtttctaaagcagatggagcacctgatatgacgtctgcaaatgatgtttccaatataccgccaatcaagcagccggaacaggtgatttgccaatgggatggttgcaataagtcattttccagtgctcaggaattaaacgaccatttagaagcagtacatttaacccggggtaagtctgaataccaatgcttgtggcatgactgccatcgtacgttcccccaaagacaaaaattaatccgtcatttaaaagtgcattcgaaatacaaaccttataagtgcaagacatgtaaaaggtgtttttcaagcgaagaaactttagttcagcataccaggacacactctggcgaaaaaccttacaaatgtcacatttgtaataaaaaattcgcgatttcaagttctttgaagattcatataagaacccatactggtgaaaaacctttacaatgcaagatttgtggtaagagattcaacgaatcgtcaaatttgagcaaacatattaagacccatcagaaaaaatacaagtgctctgactgttccaaaagctttgacgatttgggaaaattgaactcacagaaagtgaaatgcgcattggaaagaaaaccatatttataa

SEQ ID NO: 288 - DNA, 2748 bp, Saccharomyces cerevisiae
atgctccaattcaatacagaaaatgatactgtagctccagtgtttcccatggagcaagatataaatgcagcacctgatgccgtcccactggtgcagacaacaacactacaagtctttgtaaagcttgccgaacccatagtgtttttaaaaggatttgaaactaacggactgtctgaaatagcccccagtatcttacgaggatctcttatcgtcagggtgttgaaaccgaataaattaaaaagtatatcgataaccttcaaaggaatatccagaacagagtggccggaaggtataccaccgaagagagaagaattttcagatgttgaaactgttgtcaatcacacatggccattttatcaggcggatgacggcatgaattctttcaccttagaacatcacagctcaaataattcgtccaatcgcccatctatgagcgatgaagattatctacttgaaaaaagcggtgcttcagtatatatcccaccaaccgctgaaccccctaaagataatagcaatctaagtctggatgcctatgagcgcaactcattgtcatccgataatttgagtaacaagccagtatcaagtgatgtttcccatgacgacagtaaactgttggctattcaaaagacaccattaccatcatctagtcgaagaggatcggtaccggcaaattttcacggtaactctttgtcacctcataccttcatatctgatttgttcacaaaaacattcagtaatagtggcgctactccaagtcctgagcaagaggataactatcttacaccatccaaagattctaaagaagtttttatttttcgaccgggcgattatatttacacttttgaacagccaatatcgcaatcttatccagaaagtataaaagccaattttggttccgtggagtataaactgtcaatagacatagagaggtttggcgcattcaaatcaactatacatactcaattacccatcaaagtcgtaaggcttccttctgatggatccgtagaagagactgaagctattgcaatttccaaggactggaaagatcttcttcattatgacgtggtaattttctcgaaagagatcgttttgaatgcatttttacccatcgatttccatttcgctcctctagataaagttactctgcatcgtattagaatttatctaacagagtctatggaatacacttgtaatagtaatggaaatcacgagaaggctcgtagattagagccaactaaaaagtttctgttggctgaacataacggtcctaaactgcctcatataccagctggttcgaatcctttgaaggctaaaaatagagggaacatcctcttggatgaaaaatccggcgatctagttaacaaagattttcagttcgaggtgtttgtcccaagcaagtttacaaacagtatacggttacaccctgatacaaattatgataaaatcaaagcccaccattggataaaaatttgccttcgtctttccaagaagtacggggacaatagaaaacatttcgaaataagtattgattctccaatccatattttaaatcaactatgctcacacgcgaatactttgctaccgagctacgagagtcatttccagtattgtgatgaagatggtaatttcgcaccagcagcagatcaacaaaattacgcaagtcatcatgattccaatattttcttcccaaaagaagttctttcgtctcccgttctttcacctaacgtgcagaagatgaacattagaataccgtctgatcttccagtagtgcgtaatagagctgaaagcgtaaagaaaagcaagtcagataatacctccaagaagaatgatcaaagtagcaatgtcttcgcatccaaacagctggtcgcaaacatttataagcccaatcagattccaagagaattaacttctcctcaggcgttaccattatcgcccatcacctcaccaattctcaattaccaaccattatcaaactccccgcctccagattttgattttgatctagctaagcgcggcgcagccgattctcatgctattcctgtggatcctccatcatattttgatgtattaaaggccgatgggattgaattgccatactacgatacaagttcatctaaaattcctgaactaaaactaaacaaatctagagagacattggccagcattgaggaggactcattcaatggttggtctcaaattgatgacttatccgacgaagatgacaatgatggcgatatagcatctggtttcaacttcaagctgtcaaccagtgctccgagtgagaacgttaattcacacactcctattttgcagtctttaaacatgagtcttgatgggagaaaaaaaaatcgtgccagtctacacgcaacatcagtgttacctagtacaataagacagaacaatcagcatttcaatgacataaaccagatgctaggcagtagtgacgaagatgcctttcccaaaagccaatcattaaatttcaataagaaactaccaatacttaaaattaatgataacgtcatacaatcaaacagcaatagtaataacagagttgataatccagaagatacagtggattcttcagtcgatattacagcattttatgatccaagaatgtcatcagattccaaatttgattgggaggtaagcaagaaccatgttgacccagcagcctactcggttaacgttgctagtgaaaaccgtgtactggacgactttaagaaagcatttcgcgaaaagagaaaataa

SEQ ID NO: 289 - DNA, 1854 bp, Saccharomyces cerevisiae
atggcagacttgccacagaaggtatctaatttaagcatcaacaacaaagagaatggtggtggtggcggcaaatcatcttatgtcccaccgcacttgagaagtagaggaaaaccatcattcgaaagaagtaccccaaaacaggaagataaggttacgggtggtgattttttcagacgtgctggaaggcaaactgggaacaatggcgggttttttggcttttctaaggaaagaaatggagggacgagtgcgaactataaccgcggaggcagctcaaattacaaatcatctggaaatagatgggtaaatggcaagcatataccggggcctaagaacgcgaaattagaagccgaactgtttggtgtacacgacgatcccgattaccattcatctggtataaagtttgataattacgataatattcccgtagatgcatctggaaaagatgttcctgaacctatactagattttagttctccccctctggatgagctgttaatggaaaatatcaaacttgctagtttcaccaaacctactccagtacaaaaatattctattccaatagttaccaaaggtagggatttgatggcatgcgcacaaacgggctcaggtaagacaggtgggtttttgtttccgctcttcacggagctattcaggtctgggccctctccagtacccgagaaagcacagagcttttattctagaaagggatatccatctgctttagtacttgcaccaactagagaattggctacccaaatttttgaagaagcaagaaaatttacgtatagatcttgggttaggccatgcgttgtttatggtggcgcgccaatcggtaaccagatgagggaggttgaccgcggctgtgacttattggtggctacaccagggcggctgaatgacttattagaacgcggaaaagtttctttggctaatatcaaatacctggtattggatgaggctgatagaatgctagatatgggattcgaaccccaaattcgccatatagttgaagaatgtgatatgccctctgtggaaaatagacagaccttgatgttttccgccacattcccagtagatatccagcatttggcacgcgatttcttagataattatatttttttatcagtaggaagagtcggttccacctcagaaaatatcacgcaaagaatattatatgtcgatgacatggacaaaaagtctgcgttgttagatttactgtctgcagagcataagggattgacattgatttttgttgaaacgaaaagaatggcggatcaactcacagattttttgatcatgcaaaatttcaaagctacagccatacatggtgaccgcacacaggctgaacgtgaacgtgccttatctgctttcaaagctaacgtagctgatatcctggtcgcaacagctgtagcagcgagaggtttggatataccgaatgtcacacatgtcattaattatgatttgccctccgacatcgatgactacgttcacagaattggtagaacaggccgtgctggtaacacaggcgtggctacttcattcttcaatagtaataatcagaatattgtgaagggtttgatggaaattttaaatgaagcgaatcaagaagttcccacgtttttaagtgacctgtcaagacagaattcaagaggtggaagaactaggggaggaggaggttttttcaatagtcgtaataacggttcaagagactaccgtaaacatggtggaaatggctcatttgggagcacgaggccaaggaatactggaacatcaaattggggttcgattggaggtgggtttagaaatgataatgagaaaaacggttacggaaatagcaacgcttcatggtggtaa

SEQ ID NO: 290 - DNA, 2667 bp, Saccharomyces cerevisiae
atgtctacaaaaggtttgaaagaagaaatcgatgatgtaccatcagtagaccctgtcgtttcagaaacagtcaattctgctttagagcagttgcaactagatgatccagaggaaaacgccacctctaatgcatttgcgaataaagtttctcaagattctcaattcgctaatggccctccgtcgcaaatgtttccacatccacaaatgatgggtggaatgggcttcatgccctactctcaaatgatgcaggttcctcataatccttgtccattttttccgccccctgattttaatgatccaacagcaccattgagtagctcgcccttgaatgcaggcggtccaccaatgttattcaagaatgactcacttccatttcaaatgctgtcttcgggtgctgcggtagcaactcaaggtggacaaaatctaaacccattgataaatgacaattcaatgaaggtattgccaatcgcatcggctgatccgttatggactcattcaaacgtaccaggatcagcatctgtagccattgaagaaaccaccgctactctacaagaaagcctaccatctaagggcagggagtctaataataaggctagttcgttcagaagacaaacttttcatgctttatcaccaactgaccttatcaatgcggccaacaatgtaaccttgtcaaaggacttccaatctgacatgcagaatttttctaaggctaagaaaccgtctgtaggagctaacaatactgcaaaaaccagaactcaatccatatcttttgataatactccctcctcaacgtcatttatacccccaaccaatagtgtttctgagaaattatccgatttcaaaatagaaacctcgaaggaggatttgattaataaaactgcaccagctaaaaaagagagtcctacaacttatggtgcagcatatccatatgggggacctttacttcaaccaaatcctattatgccaggccacccacataatatatcctcccctatctatggtattagatcaccttttcctaattcttatgaaatgggcgcgcaatttcaacctttctctccgattttaaatcctacgagtcattcactaaatgcaaattctccaattcctctaacccaatcgccaattcatcttgcaccagttttaaaccctagttcaaattctgttgccttttcagatatgaagaatgatggtggtaagcccaccaccgataacgacaaggcgggtccaaatgttaggatggatttaataaatcctaatcttgggccatcaatgcaacctttccacatattacctccccagcaaaacaccccccctcctccctggctttatagcactccacctcccttcaacgcaatggttccgcctcatttgttggctcaaaatcatatgccgttaatgaatagcgccaataataaacatcatggtcgtaataacaatagcatgtcaagtcataatgacaatgacaacattggtaattctaattacaacaataaagacacaggtcgttctaacgttggtaaaatgaaaaatatgaaaaacagttatcatggctactataataacaataataataataataataataacaataataataataacagtaatgctaccaacagcaacagcgcggaaaaacaacgtaaaattgaggagtcgtcgagatttgcggacgcagttttagaccaatatatcggaagtattcactcattgtgtaaagaccaacatggttgtcgttttctgcaaaagcagttggatattctcggcagtaaggcggcggacgcaatttttgaagaaactaaggattatacggttgaattgatgactgattcattcggtaattatttgatccagaagctattggaagaggttaccacagaacaaagaatcgtactcacaaaaatatcttcccctcattttgtcgaaatttccttaaaccctcatggtactagggcattacaaaaactcattgaatgcatcaaaacagatgaagaagcacagattgttgttgattctttacgcccttatactgtccagttgagtaaggatttaaatggtaatcatgttattcaaaaatgtttgcaaaggttgaagcctgaaaacttccagtttatctttgacgcaatctctgatagctgtattgatattgctactcatagacacgggtgttgcgttttgcaacgttgtctagatcatgggactacagaacaatgtgacaatctgtgtgataagttgctagcccttgttgataaattaactttggatccatttggcaactatgtggtgcaatatataattaccaaagaggctgagaagaacaaatatgattatacgcataaaattgtccacctgttgaaaccaagagccatcgaactttctatccataaatttggatcaaatgtgattgaaaaaatcttgaagacagctattgtttcggagccaatgattctggaaattttaaataatggtggcgagacgggtattcaatcattgttgaatgatagctacggaaattacgttttacagacagcattagacatttctcataagcaaaatgactatctctataaaagactatcagagattgtggcgcctttactggtgggccccataagaaatacacctcatggtaaaagaatcatcggaatgttacatttagattcatag

SEQ ID NO: 291 - DNA, 705 bp, Saccharomyces cerevisiae
atgtcagatcttcaaaagttacagaggttctcaacctgtgatatttcggacggattgttgaatgtttataacattccaacgggtggttatttccctaatctaacagcaatttctccaccgcaaaatagctccatagtaggcactgcatacacagtactgtttgcacccattgatgatccaagacctgccgtgaactatatagactctgtccctcccaactcaatactcgtcctcgcactggagccccatttgcaaagtcagttccacccatttattaaaattacgcaagcgatgtacggggggctgatgagtaccagagcacaatatttgaaatcgaatgggacagtagtctttggacgcataagagatgtggatgaacaccggactttaaaccatcccgtttttgcttacggtgttggatcttgcgctccaaaggctgtcgttaaagccgtaggcactaacgtacagttgaaaatcttaacgagtgatggcgtaacccaaacaatatgtcctggtgattatattgcaggtgacaataatggaatagtacgcattcctgttcaagagactgacatttcaaaattagttacctatatcgaaaagtcaattgaagtggatttacttgtctctgaagatattaagaatggtattcccgccaaacaagctcaaaatgatcgaagatcagtattaaagaaatacatttaa

SEQ ID NO: 292 - DNA, 3486 bp, Saccharomyces cerevisiae
atggttaatataagcatcgtagcaggaattgtagccttagctactagtgcggctgctattacagcgaccactactttatctccttacgatgaaagagtcaaccttattgaattggctgtttatgtttctgacatcagagcccacatatttcagtactactctttccggaatcaccataagactgaaacatatccttcggaaatcgcagcagccgtttttgactacggtgatttcactactcgattgaccggtatttcgggtgatgaagtaactagaatgatcactggtgttccgtggtactctaccagattaaagccggctatctcttcagcgctttcaaaggatggtatttacacggctatcccaacctctacttctacaacgactacaaaatctagtacttcgactactcctaccaccactatcacttctactacttctaccacatcgactactcctacaacctctactacttctaccactcctacaacttctaccacatcgactactcctacaacctctactacttctaccactcctacaacttctaccacatcgactactcctacaacctctactacttctaccactcctacaacttctaccacatcgactactcctacaacctctactacttctaccactcctacaacttctacaacttctaccactcctacaacttctaccactcctacaacttctacaacctccaccacttctcaaacttccaccaaatcgactactcctactacttcaagcacatcgactactcctacaacttctaccactcctacaacttctacaacctctaccgctcctacaacttctacaacttctacaacctctaccacttctaccatttctaccgctcccacgacctctacaacttcaagcactttcagtacttctagtgcctctgcatcctctgtcatttctaccactgctacaacctctaccacttttgccagtcttactacacctgccacatctacggcttctactgaccatacaacctctagtgtctcaacaactaacgcattcactacttctgcaactactactactacgagcgatacatatatcagttcaagtagtcccagccaagtcacttcatccgctgagcctactactgtcagtgaagtcacctcttctgttgaacctaccaggtctagtcaagtcacttcatccgctgaacctactactgtcagtgaattcacctcttctgttgaacctaccaggtctagtcaagtcacttcatccgctgaacctactactgtcagtgaattcacctcttctgttgaacctaccaggtctagtcaagtcacttcatccgctgaacctactactgtcagtgaattcacctcttctgttgaacctaccaggtctagtcaagtcacttcatccgctgaacctactactgtcagtgaattcacctcttctgttgaacctaccaggtctagtcaagtcacttcatccgctgaacctactactgtcagtgaattcacctcttctgttgaacctatcaggtctagtcaagtcacttcatccgctgaacctactactgtaagtgaagtcacctcttctgttgaacctatcaggtctagtcaagtgaccacgacagaacctgtttcttccttcgggtctactttcagtgaaatcacctcttctgctgaacctctctctttcagtaaagcaaccacttccgcagaatctatctcctctaatcaaatcaccatttccagtgaactaatagtttctagtgtaattacttcctcttctgagattccttcttccattgaagtacttacttcaagcgggatcagttcatcagttgaacccacttctttggttggaccttcttctgatgaatccatttcttctactgaaagtctatctgcgacatccactttcacttcagccgttgtttcctcgagcaaggctgctgatttctttaccagatccactgtttctgctaaatctgatgtctctggtaactcctctacccaatctactaccttttttgctacgccttccactccacttgctgtttcttcaactgtggtcactagctctaccgattcagtttctcctaatattcccttcagtgaaatcagttcctctccagagtcgtctactgcaattacgtctacatccactagcttcattgctgagcggacttcttccttatatctttcgtcatcaaatatgtcaagtttcactttaagtactttcactgtttcccaatcgatcgtctcttcattttctatggaacctacatcgtcagtcgcatcttttgcatcaagttcccctctcttagtatcctcaagaagtaattgcagtgatgccagaagttccaacaccatcagtagcggtctgttcagcacgatagaaaatgttcgtaatgcaacctcaacatttacaaacctatcaacagatgaaattgtcatcacgagctgtaagagtagttgtactaatgaagatagtgttttgacgaaaactcaagtttctaccgttgaaactactataactagttgttcgggtggtatttgtaccacgctgatgtctccggttactactattaatgctaaggcgaacacattaacaactacagaaacttccacggtcgaaacaactataacaacatgccctggtggtgtttgctcgaccctgactgttccagttactacaatcaccagcgaagccactaccaccgctaccattagttgcgaagataatgaagaagatatcacttctactgaaaccgagttgctaactttggaaactactataactagttgttcgggtggtatttgtaccacgctgatgtctccggttactactattaatgctaaggcgaacacattaacaactacagaaacttccacggtcgaaacaactataacaacatgctctggtggtgtttgctcgaccctgactgttccagttactacaatcaccagcgaagcaactaccaccgctaccattagttgcgaagataatgaagaagatgtcgcctctactaaaaccgagttgctaactatggaaactactattactagttgttcgggtggtatttgcaccacgctgatgtctccggttagtagtttcaactccaaagccactacatcgaacaatgcagagtcgaccatccccaaagcgattaaagtcagttgctctgcgggtgcctgtaccaccctgactactgtcgatgcagggattagcatgtttaccagaaccggattgtctatcactcaaactactgtgaccaactgctcaggtggaacctgtaccatgttaactgcaccaatcgcgaccgctaccagcaaagtcatctcaccaattccaaaagcctcctcggctacttccattgctcattcatctgcttcttatactgtcagtatcaataccaacggtgcctataatttcgataaagataacatttttggtaccgctatcgttgctgttgtcgctttattactgctatag

SEQ ID NO: 293 - DNA, 2433 bp, Saccharomyces cerevisiae
atggatggttttcgtgtagctggtgcgttagtagttggtgcgttaaccgctgcatatttatattttggcggaaggttttcgatagcgctggtcattatagtaggttatggtatttattgcaatgaagccagcggtggtagtcaagatagtcaagagaagctcgatttgaacaaacaacagaaaaagccatgttgcagtgataagaagattgcggatggaggaaaaaaaactggcggatgttgttctgataagaagaacggtggtggtaaaggtggaggatgctgttcctcaaaaggtggaaagaaaggggggtgttgttcatctaaaggtggaaagaaaggaggatgttgttcctctaaaaagaatattggtgacaatgaaaatactgccactgaagttgagaaagccgtaaattaccctgttactgtggattttacagaagtttttaggaagcccactaagaaaaggtcgagtacccccaaggttttttcgaaaaatagctcgtctaactctagagtaggtaaaaaattaagtgtttcaaagaagataggtccagatggattgatcaagagcgcgttgactatttcgaatgaaacgcttttgagttcacagatctatgtgttatatagttccctgcaaggtgcagcttcgaaagctgcaaagagcgtttacgacaaactaaaggaattggatgaattgactaatgagccaaaacttttgaaccttgacgatctatccgatttcgatgactattttataaatgttcccgttgaaaatgcattgtatgtgcttgttttaccgtcttatgatatcgattgccctctagattatttcttacaaactcttgaagagaatgcgaatgattttagagtagatagtttcccattacgaaaattggttggctacacagttttggggcttggtgattcagaatcatggcctgaaaagttttgttatcaagccaaaagggccgatcactggatttctcgtttaggtggcaggagaattttccccttaggcaaagtttgtatgaaaacaggaggtagtgccaaaatcgatgagtggacatcattgttagcagagactttgaaagatgatgaaccaattatttatgagtatgatgaaaacgcagactctgaggaagatgaagaagaaggtaatggtagtgatgaattaggcgatgtagaagatattggtggtaagggtagtaatggaaagttttcaggcgcagatgaaatcaaacaaatggtggcgaaagacagtccaacgtacaagaacttgacaaagcaaggttacaaagttattggttcccattcaggcgttaagatctgccgatggactaagaatgaactacgtggtaaagggtcttgttataaaaaatcgctcttcaatatcgcgtccagtagatgcatggaattgactccttctttggcatgttcatccaaatgcgttttctgttggaggcatggtacaaatcccgtgtcaaaaaactggagatgggaagtagatgaaccagaatacattctagaaaatgctctgaagggacactattccatgatcaaacagatgagaggtgtgcccggtgttattgcagaaagatttgcgaaagcgtttgaagttcgtcattgtgccttgtctcttgtcggcgagcctattctttatcctcatatcaataaatttatccaattattacaccaaaagggcataactagtttccttgtgtgcaatgcccaacatccagaggccttgagaaatattgttaaagtaacacaattatatgtttctattgacgcacccaccaagacagagctgaaaaaagtggatagacctttgtacaaagatttctgggagagaatggtagaatgcttagagattttgaaaactgtacaaaaccatcaaaggacagttttcaggttaactttagtgaaaggtttcaatatgggtgatgtcagtgcatatgcagatctggtccaacgtggtttaccaggtttcattgaagttaaaggcgccacgtttagtggctcatctgatgggaatggtaatcctttgacaatgcagaatattccattttacgaggaatgtgtaaaatttgtgaaggcgtttaccacggaattacaaagacgtggattacattacgacttggctgccgaacatgcgcattccaactgtttattaattgcagacacgaaattcaaaattaatggagaatggcatacacatatcgattttgataaatttttcgtattgctaaactcgggcaaagacttcacgtacatggactatttagaaaagacacccgaatgggcattgtttggcaatggtgggtttgcaccagggaatacaagagtgtacagaaaagataagaaaaagcagaataaggaaaatcaagaaactacaacgagagagacgcctctccctcctattcctgcttaa

SEQ ID NO: 294 - DNA, 1332 bp, Saccharomyces cerevisiae
atgtctttataccctttacaaagatttgaatcaaatgacacggttttcagttacactttgaattctaagactgagctgtttaacgaaagccgcaataacgacaagcaacattttacccttcaactcataccaaatgccaacgccaatgccaaggaaattgacaataataatgtagaaattatcaacgatctaacaggcaatactattgtcgacaattgtgtaactacagctacttcatcaaatcagttggagagaaggctttcgatatccgactatcgtaccgaaaacggtaactactacgaatacgagttttttggtaggagggaacttaacgaaccattatttaataacgacatcgtagaaaatgatgatgacatcgatctaaataatgaaagtgatgtattgatggttagcgacgacgagttggaggtaaatgaaagattttcctttctcaagcaacagcctcttgacgggctgaacaggatttccagtactaataacttgaaaaatctggagatacatgaatttataatagatccaacggaaaacattgacgatgagcttgaagactcttttaccactgtgccccaatctaaaaaaaaagttagggactatttcaaattaaacatattcggcagtagtagcagtagtaataataacagtaatagccttggttgtgaacccattcagaccgaaaactcttcctcgcagaaaatgttcaaaaatagattcttcagaagtaggaaaagcactctaatcaagtctcttcctcttgagcaagaaaatgaagtgcttataaattcagggtttgatgtttcctctaatgaagaaagtgatgagagtgaccacgcgataataaatccgttaaagctggtgggaaataacaaggatatctctactcaaagcattgctaagacaacgaatccatttaagtctggcagtgattttaagatgattgagccagtttcaaaattcagcaatgattcgagaaaggacttattggctgccatatcagaaccatcctcttctccttctccttctgcaccatcaccttcagtacaatcttcctcttcttctcatggcttagtggtgaggaagaagacaggaagcatgcagaagacgcgcggaaggaagccctctttaattccggacgcttccaagcaatttggttgtgaattttgcgatagaagatttaaaagacaagagcatttgaagaggcatgtcagatctttacatatgtgcgaaaaaccatttacatgccatatctgtaataagaacttcagcagaagcgataatttgaatcagcacgttaaaactcacgcttccttatga

SEQ ID NO: 295 - DNA, 3351 bp, Saccharomyces cerevisiae
atgttaatgacaggttccgttggcgacggtagtgaattcgattgggaagaccaaaaaactttcatctctagagatggcggtttaacgtggagatttgttcataattcttctgggttatatgctactggtgacctgggaaatattattgtgtatatcccatatgatccagaggaagatggcgattttcaatctgaattttattattctttggaccaaggtagaacatggaatgaatatgagctgaccaatgccataagttctgtccatccctacaaattgataaatccaacaccagatggatctggctcaaaatttatttttaaaggaacgtttgccactaccgattccgaaaccaacagtataacttctttaaaaggtgtcgagtatataattgatttttcagcagcattcgactctagaacgtgtgaggaggaagattttgaagattgggatttggcggatgggaaatgtgttaatggcgccaaatacaagtatagaaggaggaaacaagacgcccagtgtttggtaaaaaaagcattcaaagatttgagtttagatgaaacgccttgtaatagttgtggtgaatccgactacgaatgttcgtttgaatttgttagggacgcaaacggcctgtgtataccagattataatctgattgccttttccaacatatgtgacaaatcgaaggataaatctgtgttagtagagccattacaattaatcaaaggtgatgaatgtaaaacacccatgaaaattgaacccgttgatattccgtgtgacgaaattccagaggagggttcgagtgacagggaaatagtgaccactgaaaacaaatttgacttcgaaattaaattttaccaatacttcgatacagttgccgacgaatctttggtcatgctgaattcgataggagacgcctatatatcccacgatggtggacaaacaataaaaaggtttgacactaacggcgaaaaaattgttgaagttgtgtttaacccatatttcaattcttcagcatatttgtttggctctaaaggtaacatattctcaacacacgatagaggacactcttttatgatagctaaattacctgaagccaggcaattaggtatgccactagattttagtgctaaagcacaggatacttttatttactatggtggcaagaattgtgaatcaatcttaagtccagaatgtcatgcagtagcatacctcaccaaagatggaggtgaaacttttacagaaatgcttgataatgcaattcattgtgagtttgcaggcacactctttgaatatccgtcaaatgaggagatggttatgtgccaagtaaaaaagaagtcttcagaaacaagaagcttggtttcttcgatagattttttccaaggtgataataaaattatctttgaaaacattatcggctacttgtccactggtggctatattattgttgccgtacctcatgaagacaatgagttgagggcatatgtaactattgatggtactgagtttgccgaggcaaaattcccgtatggtcaagatgttagtaagcaagaggcattcactattttaggatctgagaaaggatcgatatttttacatttagcaacaaacttagaatcaggacacgattttggaaaccttttgaaatccaactcgaatggtacttcttttgtcactttagagcatgccgttaatagaaacacattcggttatgtcgactttgaaaaagttcaaggtcttgaaggtattattattaccaacatcgtttcgaatagggaaaaggttggagagaacaaggaagacgaacaattgaagacgaaaatcacctttaatgacggttcagattggaactttttgaagcctccaaagaaggattcggaagggaaaaagtttccctgtgattctgtatcattagataaatgttctctacatttgcatggttacactgaacgtaaggatatcagggatacatattcctccggttccgcgttaggaatgatgtttggtgtcggaaatgttggcgataagcttctaccatatgaggagtgttccacttttttaaccactgatggaggagagacgtggactgaggttaaaaaaggcccccatcaatgggagtacggtgatcatggtggagtcttggttttggtccccgaaaacgcagaaactgattctatttcttactccaccgattttggtaaaacatggaaagattataaattctgtggcgacaaagtcctcgtaaaggatataatcaccgttcccagagattctgctttgaggtttttgctatttggagaagcaaaaaacatgggtagtggttcattcagaacgtatacaattgattttagaaacatcttcgagaggcaatgtgagtttgatattacgggtaaaaaaagggcagattttaagtactctcctctgggttccagaactggttgtctatttggtcatcaaaccgagtttttacgtaaaaccgatgaaaaatgttttattgggaatattccactttctgaattttcgaggaacgtcaaaaactgttcatgtacgaggcaagatttcgaatgtgactataatttttataaagccagtgatggtacttgtaaattagtcaaaggcttaagttcggcgaatggtgccgatatctgcaaaaaggaacccgacttaattgaatactatgattcctctggctatcgaaaaattcccttatcaacctgtaaaggtgggctgaaattggatgcacatttagcaccacatccttgtccgggaaaagaaaaggcattcagggaaaaatattctataaacaccggcgcttatgcgctggtttttgttacaattcttctcgttattttctttgccgcatggtttgtatacgatagaggtatcaggagaaatgggggattttcaagatttgaagaaataagattaggagacgatgggctgatagaaaacaataggaccgatagagttgtcaacatcattgtaagactaggattatgcatttctttaattaccaagtctgcatttcaacgcacgaaggcaggtgtagcacgcttttcttcaaaattaagggcaaggtttggcaacagaaaaggtcctacttactcttcgctgcttcagggtcagttttcagatgaatcagatggcttgcatgaagatgctaacgatttatccagtttcacaagtcaagacagtaattttgaaattgaacaagaagatgcttacagacccgaacaagagcacacgtcacagatagaccagcctgccactagcaatattccagacgcattgccagcacgtagtgctattcacaagcctgattcaactgctgtgcgcaacgaggacgagtaa

SEQ ID NO: 296 - DNA, 1803 bp, Saccharomyces cerevisiae
atgattaacgataaactagtacattttctgatccagaattatgatgacatcctaagagcaccgctttctggacagctcaaagatgtgtattcactgtacatcagtggcggatacgatgatgagatgcagaagttgagaaacgataaagacgaggtcttacagtttgaacagttttggaatgatcttcaggatattatatttgcaacgccgcagtccattcaatttgaccagaatctattagtggcagataggccagaaaaaattgtttacctggacgttttttccttgaaaattctctataacaagttccatgccttctactatacattaaaatcgtccagttcttcatgtgaagaaaaagtgtcgagtttaacaacaaaaccggaagctgattcggaaaaagaccaactgctgggtagactgcttggagtcctgaactgggacgttaacgtcagcaaccaggggttaccacgtgaacaactgagcaatcgcttacaaaatttattgagggaaaaaccatcatcttttcagcttgctaaagaaagagccaaatacacgaccgaggtcattgaatacatcccgatatgtagtgactattcgcatgcatctctattgtccacctcggtgtacattgtcaataacaaaatcgtttctttacaatggtccaaaatatccgcatgtcaggaaaatcacccaggattaattgagtgcattcaatcaaaaattcactttatccctaatatcaaaccacaaactgatatttcgttaggagattgttcctatttggatacctgtcataaattaaatacgtgtcgatacattcattacctgcaatatattccgtcatgcttgcaagagcgagctgatcgtgaaactgcgagtgaaaataaaagaatacggtcaaacgtttccattccattttatactctgggcaattgctccgcacattgtatcaaaaaggctttacctgcacagtggatccgttgcgatgtgcggaaatttgattttagggttcttggaaagttttcggtagttattgcagatcctgcatggaatatccatatgaacctaccatacggtacttgcaacgatattgaactattaggtttgcctttgcacgaactacaagatgaaggtattatttttctttgggtgacgggtagagctatagaattgggtaaagagtctttgaataactggggttacaacgtgataaatgaagtttcatggataaagacaaaccaactgggtagaacaattgttacaggtcgtacgggtcattggttaaatcattctaaggagcatttattggtgggcttaaagggtaatccaaagtggatcaacaaacatattgacgtcgatttgatcgtatcaatgaccagagagactagtagaaagcctgatgaactgtatggtatagcagaacggttggcaggcacccatgccagaaaactagagatattcggaagggatcacaatacgcggcctggctggtttaccatcggaaaccagttgacaggaaattgcatttacgaaatggatgtcgagaggaagtaccaggagtttatgaagagcaaaactggaaccagccacactggtactaaaaaaatcgacaaaaagcaaccttcaaaattacagcagcagcatcagcagcagtattggaataatatggatatggggagtggtaagtattatgctgaggccaagcagaatcctatgaatcaaaaacatactccctttgaatccaaacagcaacaaaaacaacaattccaaacactaaataacctatattttgctcagtaa

SEQ ID NO: 297 - DNA, 3342 bp, Saccharomyces cerevisiae
atgtttggagttagccgtggcgcattccccagcgcaacaacacagccatttggctcaacaggatcaacctttggtggccaacagcaacaacaacaaccagtagcaaacacttctgctttcggcctcagtcagcaaacaaatacaacacaagcacctgcgtttggtaactttggtaaccaaacttctaattctcccttcggaatgtcaggctcgactacagcaaatggtactccttttggtcaaagtcaattgacgaacaacaatgcctctggctcgatcttcggtggaatgggtaataacacagcactttctgctggttccgcttctgttgtgcccaattctactgcaggtacaagcattaaaccttttactacattcgaagagaaggatccaaccacaggtgtcatcaacgtcttccaaagtatcacctgtatgcctgaatacagaaatttttcttttgaagaattgagatttcaagattaccaagctggtagaaaattcggtaccagtcaaaatggcactggtactacttttaacaatcctcaaggaactaccaatactggatttggaattatgggtaataataactccactacttctgctacaacaggaggattatttggtcaaaagccagcaacaggcatgtttggaaccggaactggaagtggtggtggctttggctctggagcgaccaactctacaggattgtttggaagctctactaacctctcaggaaattctgcatttggagcaaataaacctgccacttccgggggattgtttggtaatacaactaacaacccaacaaacggcactaataatacaggccttttcggccagcagaactcaaatacaaacggaggattatttggtcaacagcaaaattcatttggggcgaataatgtcagtaacgggggagcctttggtcaggtgaatcgtggtgcctttccccaacaacaaacacaacaaggtagtggtggtatatttggtcaatcaaacgctaacgcaaatggtggcgctttcggccaacagcaaggcactggtgctctttttggagctaaacctgcttctggtggactatttggacaatctgctggttcaaaagcattcggaatgaataccaaccccactggtaccactggtggcttatttgggcaaaccaatcagcagcaaagtggaggagggttatttggccagcaacaaaattccaacgctggaggattgttcggtcagaataaccaaagccagaaccaatccggattatttggacaacaaaactcctcaaacgcatttggccagccacagcaacaaggcggattatttggaagcaaacctgcaggaggactgtttggacaacagcagggagcatccacttttgcgtctggtaatgcccaaaataattctatatttgggcaaaataaccaacaacagcaatcaaccgggggattattcggacaacaaaacaaccagtcgcagtcccaacctggtggattgtttggccagaccaatcaaaataataatcagccatttggccaaaatgggttacaacaaccacaacagaataatagtctttttggagcgaaaccaactggttttggaaatacaagcttattctctaacagcacaacaaatcaaagtaacggtataagtggaaataatttgcagcagcaatcaggaggtttgttccaaaataaacagcaacctgcttcgggtggcctgtttggttcaaaaccatcaaacactgttggaggcggattatttggaaacaatcaagttgcaaatcaaaacaatcctgcctcaactagcggcggattatttggtagcaaacctgctacaggatcccttttcggaggtactaattccacggctccaaacgcctcttcgggtggaatatttgggtccaataatgcatctaacacggcggccaccaccaattctactggtttatttggtaataaaccagttggtgcgggagcttctacaagtgctggaggactatttggaaacaataacaactcgtctctaaacaattccaacggttcaacgggcctgtttggtagtaataacacctctcaatctactaatgctggaggcttatttcagaataacactagtacgaacacttcgggcggagggttattttcccaaccttcccagtcaatggcacaatcacaaaatgcgctccaacaacagcagcagcaacaacgattacaaattcagaataacaatccctacggtactaatgagcttttttcgaaagcaactgtcaccaacacggtttcctatccaattcaaccaagcgctacaaagatcaaagccgatgaacgcaaaaaagccagtttgacgaacgcatacaaaatgattcctaaaactttatttacagccaagctcaagactaataattccgtcatggataaggcccagatcaaggttgatccaaagttgtcgatttccattgataaaaagaataatcagattgcgatttctaaccagcaggaggaaaatttggacgaaagcatattaaaagcttctgagttattattcaatcccgataaaaggtcattcaagaatctaattaataacaggaaaatgttgatcgcatccgaggaaaagaataacggatcacagaacaacgatatgaattttaaaagtaaaagtgaagaacaagaaacgatcttgggaaagccaaagatggatgaaaaagaaactgctaatgggggggaaagaatggttttgtcctcaaagaacgatggggaagatagcgcaacgaaacatcattcccggaatatggacgaagaaaataaagaaaatgtcgccgatttacagaagcaagaatattcagaagatgataaaaaggctgtttttgcggacgttgcggaaaaagatgcctccttcattaatgagaactactatatctcaccatccctggacacattatcctcttattctctcttgcaactgcgcaaagttcctcatttagttgtgggtcataaaagttatggtaaaattgaatttcttgaacctgttgacctcgctggaattcctttgacctcattagggggcgtaatcattacttttgaaccaaaaacctgtataatatatgcgaacttaccaaacagaccgaagagaggggagggcattaatgttcgggccaggattacctgctttaactgttatcctgtagacaaatctaccagaaaacctataaaggatccaaatcatcaactggttaaaaggcatatcgaacgcttaaagaaaaatccaaattctaagttcgaaagctatgatgcagacagtggtacatacgtgtttatcgtaaaccacgctgcagagcagacctga

SEQ ID NO: 298 - DNA, 1548 bp, Saccharomyces cerevisiae
atgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaattctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 299 - DNA, 2340 bp, Saccharomyces cerevisiae
atgtcagtcttgcgatcacaacctccttcagttgtaccgctacatctgacaacatccaccagtcgcaaaacagaacaggaaccatcgctattgcactctgcaataattgagcgacatcaagaccgttcggtgccgaattcgaattcgaatccggattcgaaccatcgaataaaaaaggatcgcaataatcacactagctaccattcttcatcgaattcggagtcaaacatggaaagtcctcgcttgtcagatggtgagtcttccactccgacctctattgaagagttaaacccaacaataaataattcgaggctggtgaagagaaactactcaatatcaattgatcctttgcatgacaacagcaataataatacggatgatgatcatccaaacaccataacttctccccgaccaaatagcactagtaacaaggaaatgcagaaatatagttttcccgaaggtaaggagtcgaagaaaataacaacaccctcgttaaactcgaataattgtttggatttggacaattccagtcttgttcacacagattcgtatatacaagacttaaatgacgatcatattttactaaacaagcgcgtttcgaggcgatcttccagaatatcggcagtaacagcaacttccacgacaattaagcaaagaagaaatactcaggattcaaacctgcccaatattccctttcacgcttccaagcattctcaaattctacctatggatgattcagatgtaataaaattggccaatggagataccagcatgaaaccaaattctgctactaaaattagtcactcaatgacttctttgcctcttcacccacttccacaaccttctcaaaagtcaaagcaatatcatatgatatccaaatcaaccacttctttgccgccagagaatgaccactactatcaacacagtcgtggcaccaaccataatcacgctgctaatgctgctgctgttaataataatactactactactaccgctgctacgggtctgaaaagatcagagtctgcaacggcagaaattaagaagatgagacaatctttgctgcataaaagagaaatgaaaaggaaaagaaaaacatttttggtggatgacgatcgtgttttgatcggtaataaagtcagtgaaggccatgtcaactttattatagcttataacatgctaactggtattcgtgtcgcagtgtcacgttgttctggcataatgaaacctttaactccggcagactttagatttacgaagaagcttgcctttgattatcacggaaatgaattgaccccttcttctcagtatgcatttaagtttaaggactactgtcccgaagtctttagggaacttcgtgcattattcggcttagaccctgctgattatttggtttcgttaacttccaagtacattttgagtgagttgaactcgccaggtaaaagtggttcatttttttattattcgagagattacaaatatattatcaagaccatacatcattctgagcatattcatctgagaaagcacatacaagaatactataaccatgtaagagacaatccaaacactttgatttgtcaattttatggtttgcatagagtgaaaatgcctatatcgtttcaaaataaaattaagcatcggaaaatttacttcctagtcatgaataacttatttccaccacacttagacattcacattacttatgatttaaaaggttccacatggggccgttttaccaatttggataaagaaaggttggcgaaagatagatcatataggcctgtgatgaaagatttaaattggcttgaagaaggtcagaaaattaaattcggtccattgaagaagaagacttttttgacacagctgaaaaaagatgtggaattgcttgctaaattgaatacaatggactattccttgttaattggcattcatgacatcaataaagctaaagaagacgacttacaattggcggatacggcatctattgaggagcaaccacagactcaaggacccataagaaccggtaccggaacggtagtacgacatttttttagagagtttgaaggtggaattcgagcatctgatcaattcaacaatgatgtggatttgatttattacgtggggataatcgatttcttgactaattactcagttatgaagaaattagaaacgttttggagaagtctacgccatgataccaagttggtgagtgccatacctccaagagactacgccaataggttttacgaattcatagaagattctgtagatcctctgccccagaaaaaaactcaatcgtcgtatagagacgaccctaaccagaaaaattataaagactga

SEQ ID NO: 300 - DNA, 612 bp, Saccharomyces cerevisiae
atgttcaatcgttttaacaaattccaagctgctgtcgctttggccctactctctcgcggcgctctcggtgactcttacaccaatagcacctcctccgcagacttgagttctatcacttccgtctcgtcagctagtgcaagtgccaccgcttccgactcactttcttccagtgacggtaccgtttatttgccatccacaacaattagcggtgatctcacagttactggtaaagtaattgcaaccgaggccgtggaagtcgctgccggtggtaagttgactttacttgacggtgaaaaatacgtcttctcatctgatctaaaagttcacggtgatttggttgtcgaaaagtctgaagcaagctacgaaggtaccgccttcgacgtttctggtgagacttttgaagtttccggtaacttcagtgctgaagaaactggcgctgtctccgcatctatctattcattcacacctagctcgttcaagagcagcggtgacatttctttgagtttgtcaaaggccaagaagggtgaagtcaccttttctccatactctaacgctggtaccttttctttgtcaaatgctattctcaacggtggttctgtttccggtttgtaa

SEQ ID NO: 301 - DNA, 3135 bp, Saccharomyces cerevisiae
atgtctgattcccagcaatccattaaggttctagaagaactattccagaagttatctgttgccactgctgacaacagacacgaaatcgcttctgaagtcgcttctttcttgaatggtaacatcattgaacatgatgttccagaacacttcttcggtgaattggccaagggtatcaaggacaagaagaccgctgctaacgccatgcaagctgttgctcacattgctaaccaatctaacttgtctccatctgttgaaccatacatcgtccaattggttccagctatctgtaccaacgcaggtaacaaggacaaagaaattcaatctgttgcttccgaaactttgatttccatcgttaacgctgttaacccagttgccatcaaagctttgttgccacatttgactaacgctattgtcgaaactaacaaatggcaagaaaagattgctattttggcagctatctctgctatggtcgatgctgctaaggatcaagttgccctaagaatgccagaattgattccagtcttgtctgaaaccatgtgggacaccaagaaggaagtcaaggctgctgctactgccgccatgaccaaggctaccgaaactgttgacaacaaggatattgaacgtttcattccaagtttgattcaatgtattgctgacccaactgaagttccagaaaccgttcatttgttaggtgctactactttcgttgctgaagttactccagctactttgtccatcatggtcccattgttgtccagaggtttgaacgaaagagaaaccggtatcaagcgtaagtctgctgttattattgacaacatgtgtaagttggtcgaagacccacaagttattgctcctttcttgggtaaattgttgccaggtttgaagagtaactttgctaccattgctgacccagaagccagagaagttactttgagagctttgaagactttgagaagagttggtaacgttggtgaagacgatgctattccagaagtttctcacgctggtgacgtttctactactttgcaagtcgttaacgaattgttgaaggacgaaaccgttgctccaagatttaagattgtcgtcgagtacattgccgccattggtgctgatttgatcgatgaaagaatcattgaccaacaagcttggttcacccacatcaccccatacatgactatcttcttgcacgaaaagaaggccaaggacatcttggacgaattcagaaagagagctgtcgacaacattccagttggtccaaacttcgacgacgaagaagacgaaggtgaagacttatgtaactgtgaattctctttggcttatggtgctaaaatcttgttgaacaagacccaattaagattgaagagagccagaagatatggtatctgtggtccaaacggttgtggtaagtccactttaatgagagctattgccaacggtcaagttgatggtttcccaacccaagaagaatgtagaaccgtctacgtcgaacacgacattgatggtactcactctgacacttccgtcttggatttcgttttcgaatctggtgttggtactaaagaagctatcaaggacaaattgattgaattcggtttcaccgatgaaatgattgctatgccaatctctgctttgtctggtggttggaagatgaagttggctctagctagagctgtgttgagaaatgctgatatcttgttgttagatgaaccaactaaccatttggataccgtcaacgttgcttggttagttaactacttgaacacctgtggtatcacttctatcactatttctcacgactccgttttcttagataacgtctgtgaatatattattaactacgaaggtttgaagttgagaaagtacaagggtaactttaccgaattcgttaagaagtgtccagctgctaaggcttacgaagaattatccaacactgatttggaattcaagttcccagaaccaggttacttggaaggtgttaagactaagcaaaaggctattgtcaaggttaccaacatggaattccaatatccaggtacctctaagccacaaatcactgacattaacttccaatgttctttgtcttccagaattgctgtcattggtccaaatggtgctggtaagtctactttgattaacgtcttgactggtgaactattaccaacctctggtgaagtctacacccacgaaaattgtcgtatcgcttacattaagcaacacgcttttgctcatatcgaatctcatttggacaagactccatctgaatatatccaatggagattccaaaccggtgaagatagagaaaccatggacagagctaacagacaaatcaacgaaaacgatgctgaagctatgaacaagatcttcaagattgaaggtacccctagaagaattgccggtatccactccagaagaaagttcaagaacacttacgaatatgaatgttctttcttattgggtgaaaacattggtatgaaatctgaaagatgggttccaatgatgtccgtcgacaacgcttggattccaagaggtgaattggttgaatctcactctaagatggttgctgaagttgatatgaaggaagctttggcttctggtcaattccgtccattaaccagaaaagaaattgaagaacattgttccatgttgggtttggacccagaaattgtttctcactccagaattagaggtttgtctggtggtcaaaaggttaagttggtcttagctgccggtacatggcaaagacctcacttgattgtcttagatgaacctaccaactatctggacagagattctttgggtgctttgtctaaggctttgaaggaatttgaaggtggtgttattatcattactcactctgctgaattcacaaagaacttgactgaagaagtctgggccgtcaaggacggtagaatgactccatctggtcacaactgggttagtggtcaaggtgctggtccaagaatcgaaaagaaggaagacgaagaagataaattcgatgctatgggtaacaagattgccggtggtaagaagaagaagaagttgtcttctgcggaattgagaaagaagaagaaggaaagaatgaagaagaagaaggaattgggtgatgcttacgtttcttctgacgaagaattctaa

SEQ ID NO: 302 - DNA, 1131 bp, Saccharomyces cerevisiae
atgactgacttgtttaaacctctacctgaaccacctaccgaattgggacgtctcagggttctttctaaaactgccggcataagggtttcaccgctaattctgggaggagcttcaatcggcgacgcatggtcaggctttatgggctctatgaataaggaacaggcctttgaacttcttgatgctttttatgaagctggaggtaattgtattgatactgcaaacagttaccaaaatgaagagtcagagatttggataggtgaatggatggcatcaagaaaactgcgtgaccagattgtaattgccaccaagtttaccggagattataagaagtatgaagtaggtggtggtaaaagtgccaactactgtggtaatcacaagcgtagtttacatgtgagtgtgagggattctctccgcaaattgcaaactgattggattgatatactttacattcactggtgggattatatgagttcaatcgaagaagttatggatagtttgcatattttagttcagcagggcaaggtcctatatttaggagtatctgatacacctgcttgggttgtttctgcggcaaattactacgctacatctcatggtaaaactccttttagcgtctatcaaggtaaatggaatgtattgaacagggactttgagcgtgatattattccaatggctaggcattttggtatggctctagccccatgggatgtcatgggaggtggaagatttcagagtaaaaaagcaatggaagaacggaagaagaatggagagggtctgcgtacttttgtgggtggccccgaacaaacagaattggaggttaaaatcagcgaagcattgactaaaattgctgaggaacatggaacagagtctgttactgctatcgctattgcctatgttcgctctaaagcgaaaaatgttttcccattgattggaggaaggaaaattgaacatctcaagcagaacattgaggctttgagtattaaattaacaccggaacaaatagaatacctggaaagtattgttccttttgatgttggctttcccaaaagtttaataggagatgacccagcggtaaccaagaagctttcacccctcacatcgatgtctgccaggatagcttttgacaattag

SEQ ID NO: 303 - DNA, 3252 bp, Saccharomyces cerevisiae
atgtctgactatttcacgtttcctaagcaggagaatggcggtatctcgaagcagcctgcgacaccaggttcaactcggagctcttctagaaatttggagttaccgaagaactatcgttcatttggtggtagtagcgatgaactggcatctatgtattccgccgactcccagtacttgatggatatgattcctgattcattgacgctgaaaaatgagccagcatctggaaatacgcaaatgaacgggccagatggcaaagagaataaggacataaaacttgacgagtatatattacccaagacagacccaaggtcaccctactatattaacatgcctatacctaaaaaattgccgaagagtgaaggtaaggcgagggctaaacaaaaggttaacagggctgatccttctgatttagatgtggagaacatttacgaaacttccggggagtttgttagagagtatccgacagatattttgattgataggtttcacaaatggaagaaaatcttgaaaagtttgatcgcttacttcagagaagctgcctactctcaggaacaaattgcaaggatcaactaccagatgaaaaatgccgtaaaatttgcttttcttactgatttggaagatgaaacaaacaaactggttgatccaagtatatctaagttgcctactaagaaacctcagcctgtcccattggccgctcaaaaattggacagcaagtacgacacagatgtggaacagccgcagtcaatccaatcagtaccttcggaagaggtagcttcagcttcttctggcttcatgaaatttgggtcaggatccattcaagatattcaagtgattttgaagaagtaccatttatctttgggtagtcaacaatataagatctctaaggaaatcttggcatatattatacccaaattgaccgacttgcgtaaggatttgaccacaaagatgaaagaaattaaagaattaaatggagatttcaagactaacataggcgagcatatcaaaataacaagcaggcttctgaataaatatattgcttcagtgaagttattagatgaagcatccacttcgggcgataagcaaggtgaaaaattaaaaccaaaacacgatccataccttttgaaattacaactagatttgcagctgaaaagacaattactcgaagaaaactatcttcgagaagcttttctgaatttacaatcagcagcactacaactggagaaaatagtatattctaaaattcaatccgcattacagcgctactcagcgttaattgattcagaagcacgattaatgatcaaaaatttgtgccatgaattgcagcaaggtattctatctagaccaccggctgtagagtgggataattttgtctctcatcatcctacctgtctgatgaatttaaaatcgacagacccgccaccgcaacccagaagattatctgatattgtttatcctaacatgaaatcgccgctggccaaatgcattagagtaggatatctactgaagaaaacagagtcttctaaaagttttactaaaggttattttgtgttgactacaaattatcttcacgaattcaaaagcagcgatttctttctagacagcaagtctccccgttcaaaaaataaacctgttgttgaacaatcagacattagccgtgtgaataaggatgggactaacgctggcagtcacccatcgagcaaagggacacaggatccgaaactgacgaagagaagaaagggtttgagttcttcgaatctatatcctatctctagtttgtctttaaatgattgctcattaaaggatagtactgactcaacttttgttttacaagggtatgctagttatcattcaccagaggacacatgtacaaaagaatcaagcacgacctcagatttggcatgtccaacaaagacgcttgcttcaaataagggcaaacatcaacgtacgccttcagctctctcgatggtgtccgttccgaaatttctaaagagttcttccgtgcccaaggaacaaaaaaaggctaaagaagaagctaacatcaataagaagtcaatttgcgagaagcgcgttgaatggacgtttaaaatattttccgcaagtcttgaaccaactccagaggaatcaaaaaatttcaagaaatgggttcaggacataaaagcgcttacaagtttcaattctactcaggagaggtcgaacttcattgaagaaaagattctgaaaagtagaaaccataataatggaaagagctctcaaaggtccaaaaacagtacatatatcactccagtagacagttttgttaacctttctgaaaaagtaacgccatcttcctctgttaccacgttaaacactaggaagagggcaaatcgtcctcgttatatagacatcccaaaaagcgcaaatatgaatgcaggcgctatgaattccgtatacaggtcaaaagtcaatacaccagccattgatgaaaatggtaatctggccatagtgggagaaacgaaaaacagtgctccacaaaatggtatgagttacacaattagaaccccttgcaaatcgccttattcaccttatactggggaaggtatgctttacaaccggtcagcagataacttaatggcatcctcttcgcgaaaagcatcggctcccggagaggtacctcaaatagctgttagtaatcatggggatgaagccattattccggcaagcgcgtattcagatagtagtcataaatcgtctcgtgcctccagtgttgcatccattcacaaccaacgggttgatttttatccttcgccattaatgaacttaccaggtgtttcacccagttgtctagcattggatggtaatgcaaacggatattttggaataccattgaattgcaattcggaagcaagacgagggtcagatctttcaccttttgagatggagtctccattgttcgaggaaaacagaactcaaaactgcagtggctctcgcaaaagttcagcttgtcatattccccatcaatgtggtccaaggaaagaaggtaatgactcacgattgatctacggcaatgagaagggcgcctcacaatcacgtctaacgttgaaggaaccgcttacatctaaaggtgttgaagctccttatagcagtttgaaaaagacatatagtgcggaaaacgtcccactaacatctactgtatcgaatgataagtctcttcactcgcgcaaggagggaagtactaatactgtacctgctacatccgcgtcaagtaagtga

SEQ ID NO: 304 - DNA, 591 bp, Saccharomyces cerevisiae
atgctatgtggtttaacagatgtcatcttgcccggtaaggatgctatcaccactcaaattatagattttgacaaaaacattggcttcaatgtcgaggaaactgagagtgcgcttacattgacactaaaaggcgctacgtggggcgccaattcttttgacgcaaaactagaatttcagtgtaatgacaatatgaaacaagacgagctgactagtcacacatgggccgataaaagtatccaattgaccctaaaagggccatctggctgtttgaagagcaaagatgatgacaaaaaaaatggcgacggcgataatggtaaggatggtgacagcgaggggaaaaagccagctaagaaggcaggcgggacttcgtggttcacttggttattcctatacgctctactgtttacattgatatacctgatggttgtatcattcttgaataccagaggaggctcttttcaagatttccgtgctgagttcattcaacgttctactcaatttctcacttccttacctgaattctgcaaggaagtggtttcgagaatcttaggcagaagtaccgcccaaagaggcggttatagcgccgtttaa

SEQ ID NO: 305 - DNA, 771 bp, Saccharomyces cerevisiae
atggaacaacctgatctatcgtctgtggccatcagtaagccgctgctgaagttgaaacttctcgacgcccttcgccagggaagtttccccaacctacaagatctcctaaagaaacaattccagccgctagacgacccaaacgtccaacaagtgctccatctcatgctccactatgccgtgcaagtcgcccccatggctgtcataaaggaaatcgtccatcattgggtctcaactacaaacaccacttttctaaacatccatcttgatctaaacgaacgggactccaacggcaacaccccattgcacatcgccgcctaccagtcccgcggtgatatcgtagccttcctcctggaccaaccaaccatcaacgactgcgtgctcaacaactcccacttgcaggccatcgaaatgtgcaagaacctaaacatcgcgcagatgatgcaggtgaaacgctccacatacgttgcagagaccgcccaggaattcagaacagcttttaacaacagggacttcggccacctagaatctatcctctccagccctcgaaacgcagaactgctcgacatcaacggtatggacccggagactggcgataccgttctgcacgaattcgtcaagaaaagagacgtcatcatgtgccgttggttgcttgaacacggtgctgaccccttcaagagagaccgcaaggcaaactgcccatcgagctcgttaggaaagtcaatgaaaacgacaccgccaccagcaccaagatcgccatcgacatcgaactga

SEQ ID NO: 306 - DNA, 390 bp, Saccharomyces cerevisiae
atgtcttgttcgtttcatatatcaagtcctttaggctcttcttcttccttggagggcttttcttcattgaaggtggtggttgtagcctgtcaagctctttcgagggacctccttggtattgatcttgttctcttactccttttttggcgtccagataagcacccccattgggcttccgccacctgtgttctcagacagatttttggcacgaagttgttgtttttccaattccaaattaaacagtcttctttctacaacgttgatgttgactatgggagaagtcgtaatagaccttttgttctttcttgctggagcaacttcggtgcacaagctcttttcggcattattatgtaccccgagtggtatataggagcagcttctcctatttga

SEQ ID NO: 307 - DNA, 2067 bp, Saccharomyces cerevisiae
atgatcagaagatggctaactataagtaagtctgggaagaagaaaaaggctgttaatgataccattacagaagaagtagaaaaggttgactttaagcctgtaaaccacgatataaatgatgaactctgttatagcgaatcatccgataatccctctagctcattgtttgtctctaatttggataccaaggaaacttttttgaatgaagacaataatttgcagatttcttccggactagactattcttctgaaacgtgcaatcaaggcagtaattacagccaggatgggatattttatatttcaaacgcaaaggctataaacgcatacggaggcattatcacgcaagggcccgaggcacccatattagctatgaaggtgtccgactcaatgccctatggagacggctccaacaaagtttttggatacgaaaattttggcaatacatgttactgtaactcagttcttcaatgtctctataatctgtcctcattacgtgaaaatatattgcaatttccaaaaaaatcaagagaatctgatcacccaagaaagaaagaaatgagaggtaagaaaccaagaatatttaccgaagcaagttttgagaaaagcattgctggtaccaatggacatttgcctaaccctaaacctcaatctgttgatgatggaaagcctacccctgtaaattctgtaaattcaaatacagctgggccttcagagaagaagagtaaattttttaaaagttttagcgcgaaacatgtacaagacaataataaaaaggaaggaagtcctgctatattaaccactggaaaaccctcttctcgtcctcaagacgcacctccattgatagtcgaaacacctaatgagcctggtgctccgagcagattgagtttcgagaacgtcacagatagacctccggatgttccgcgtaaaataattgttggcagagttctcaattatgaaaatccttcaagaggtagcagtaatagtaataacctggacttgaaaggagaaagtaatagcagcttatccactccacttgataaaaaagatactagaagatctagttcctcttctcaaatatccccagaacatagaaagaaatccgcacttattcgtgggccagtgctcaatattgaccatagcttaaacggctcagataaggctactttgtattccagtttgagagatatctttgaatgcataactgagaatacgtatttaactggtgttgtatcgcctagctcttttgttgatgttctcaaaagagaaaatgtattatttaatactactatgcatcaggatgctcacgaatttttcaatttcttattaaacgagttgagtgaatatatagaacgtgagaataaaaaaatagcagccagtgatatcaacagcgatagcgaaccgagtaagagtaaaaatttcatcagtgacttgtttcaaggcactttaacgaatcaaataaaatgtctgacgtgcgataacattacatctagggatgagccatttttggatttccccatagaagttcagggagatgaggaaacagatatacaggaaattttgaaaagttatcaccagcgagaaatgctaaatggctcaaacaagttttattgtgacgaatgttgcggtttacaggaggcagagagattagttggtttgaagcaattgcctgatactttaacattacacttgaaaagattcaagtattctgagaaacaaaactgtaatattaagctttttaataacattcactatcctctgacgctaaatgtttgctcttcaataaattctaaggtttgtcaaaagtatgaattggctgggattgtcgttcatatgggcggtgggccacaacacggccattatgtttccctatgtaaacatgaaaagtttggctggttgttatttgatgacgaaacggtagaggcagttaaagaggaaacagtgttagaattcacaggtgaatctccaaatatggcaacagcatatgtttgttttataaagcgatgtattcaaacgctgttgaaaagaatgatcgtgaaaatatggcaaaagaacaagatgataatatag

SEQ ID NO: 308 - DNA, 2196 bp, Saccharomyces cerevisiae
atgacagaattttattctgacacaatcggtctaccaaagacagatccacgtctttggagactgagaactgatgagctaggccgagaaagctgggaatatttaacccctcagcaagccgcaaacgacccaccatccactttcacgcagtggcttcttcaagatcccaaatttcctcaacctcatccagaaagaaataagcattcaccagatttttcagccttcgatgcgtgtcataatggtgcatcttttttcaaactgcttcaagagcctgactcaggtatttttccgtgtcaatataaaggacccatgttcatgacaatcggttacgtagccgtaaactatatcgccggtattgaaattcctgagcatgagagaatagaattaattagatacatcgtcaatacagcacatccggttgatggtggctggggtctacattctgttgacaaatccaccgtgtttggtacagtattgaactatgtaatcttacgtttattgggtctacccaaggaccacccggtttgcgccaaggcaagaagcacattgttaaggttaggcggtgctattggatcccctcactggggaaaaatttggctaagtgcactaaacttgtataaatgggaaggtgtgaaccctgcccctcctgaaacttggttacttccatattcactgcccatgcatccggggagatggtgggttcatactagaggtgtttacattccggtcagttacctgtcattggtcaaattttcttgcccaatgactcctcttcttgaagaactgaggaatgaaatttacactaaaccgtttgacaagattaacttctccaagaacaggaataccgtatgtggagtagacctatattacccccattctactactttgaatattgcgaacagccttgtagtattttacgaaaaatacctaagaaaccggttcatttactctctatccaagaagaaggtttatgatctaatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtgacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaa

SEQ ID NO: 309 - DNA, 1587 bp, Saccharomyces cerevisiae
atgcaaaatgctcaaataaagagctcttctaaaggcagcggaatagatggtacagatcgcaatagcaaagatggtgtagaaaagagacccctggaagatgtaaagcaaatgattgacgctggaacaccagatgttggccacaaatctactgttgaaactaagccaaacgttggatggcaagcctctcacagtaatttggctgcattacacgaaaaagagcagaaatatgaaatggagcaccatcatgctcgtcataaactgcatcgtcaagttattccggattacacgtctgcctcgaccgcaatgttcagcgattgtatgttcaacgcagcaccagataaagtacgaagtctcagtacgatgaagtcttctggactctcgccaaaacacccatttaacgtagtcgccacctttaaaggaccattcccgcagcatagtgtagaatcaaagcctctcgatggtggatactctgccaaagaccattttccctcatttaagatgttgcaagcccagcagcacccagcccatcgccattacaaagacaacgacaagtacggtcttaaatcaccttcccggtccttcgtgaaggacaagaaaaggttggttcaccggtttttgaaatccatggagccttcttcgtctgggcaatctaaggattcgtctgcactggcgccggctttcgatccaatattgcccaatgttatatctaagccttccaagcgacccacacatcattcgcattcatcagacgggagttctagcacgcagacagatatatcgttacagagcttgctttaccatgatcttgaaagctcaccaaagaaacatgtttcgccctcaagaccgccctctgtagcttccgaatcctctcctgccgttgctaatcccattgggctttcgccaaaagacgcctgcaatgcatcgttttcgcagtcgtcctcatcttcgttgtcttcttcttcatcgtcttcatcatcgacgtcattctcacagtcagtggctgttgatcctcttgaacctcctggaaatatcacatatagtagttcgaatctttcgctaaattcagatgaattagactactatcagcgtcatatcggattgcagttacagcagacagaagctttactaaagcacagtttgaaagatgaggttctgaaagatgaaaatgaccttgttaaaaacattgcaaattttgacaagatcgttaaagagctaagggacttaagatccaggaccattggatggaaagagcttgttgaagaggattatttaatgaatttgaaacaggattttgacaaggaaaaccccgaatcatttgaggcacgtttgagtgatacaataaatacaaacgtggcaaaattacaagatttagagaaaagaatggcttcttgcaaagacaggttggcctctaggaaggaagtaatgaggaaaatggaaagtttattgtctttggagaattccttaatgatatccaaaaaaaatgtaacattcgcatctaaataccgcaacgaggcccttgatattgtctttttaattatcatcatcgtcatatgctataccttcaagcatctagtatcgcataaataa

SEQ ID NO: 310 - DNA, 435 bp, Saccharomyces cerevisiae
atgggcaagaaagcacacggaggaaagatgaaacctgagatcgacgaaaatggtactctgctagtaccgccaccaaggacgattgcgaaccaggaccatttccatagattaaactacctctaccaaatatccgcttaccaaacaagagcaagacagaaagcaagaacagacgcacatacgcctttggcacgcaattatatcaaatcaatggacctaattagtaagaaaaccaagacatcactgcttcctacgataaagagaacaatttgtaaaaaatgccatcggttgttatggaccccaaaaaaactggaaatcacatccgacggagcgctttcggtaatgtgtgggtgcggtaccgttaaacgttttaatattggcgccgatcctaattacaggacctactcggagcgggagggtaatctactaaattcttag

SEQ ID NO: 311 - DNA, 3270 bp, Saccharomyces cerevisiae
atgtctgctttaccggaagaagttaatagaacattacttcagattgtccaggcgtttgcttcccctgacaatcaaatacgttctgtagctgagaaggctcttagtgaagaatggattaccgaaaacaatattgagtatcttttaacttttttggctgaacaagccgctttctcccaagatacaacagttgcagcattatctgctgttctgtttagaaaattagcattaaaagctcccccttcttcgaagcttatgattatgtccaaaaatatcacacatattaggaaagaagttcttgcacaaattcgttcttcattgttaaaagggtttttgtcggaaagagctgattcaattaggcacaaactatctgatgctattgctgagtgtgttcaagacgacttaccagcatggccagaattactacaagctttaatagagtctttaaaaagcggtaacccaaattttagagaatccagttttagaattttgacgactgtaccttatttaattaccgctgttgacatcaacagtatcttaccaatttttcaatcaggctttactgatgcaagtgataatgtcaaaattgctgcagttacggctttcgtgggttattttaagcaactaccaaaatctgagtggtccaagttaggtattttattaccaagtcttttgaatagtttaccaagatttttagatgatggtaaggacgatgcccttgcatcagtttttgaatcgttaattgagttggtggaattggcaccaaaactattcaaggatatgtttgaccaaataatacaattcactgatatggttataaaaaataaggatttagaacctccagcaagaaccacagcactcgaactgctaaccgttttcagcgagaacgctccccaaatgtgtaaatcgaaccagaattacgggcaaactttagtgatggttactttaatcatgatgacggaggtatccatagatgatgatgatgcagcagaatggatagaatctgacgataccgatgatgaagaggaagttacatatgaccacgctcgtcaagctcttgatcgtgttgctttaaagctgggtggtgaatatttggctgcaccattgttccaatatttacagcaaatgatcacatcaaccgaatggagagaaagattcgcggccatgatggcactttcctctgcagctgagggttgtgctgatgttctgatcggcgagatcccaaaaatcctggatatggtaattcccctcatcaacgatcctcatccaagagtacagtatggatgttgtaatgttttgggtcaaatatctactgatttttcaccattcattcaaagaactgcacacgatagaattttgccggctttaatatctaaactaacgtcagaatgcacctcaagagttcaaacgcacgccgcagcggctctggttaacttttctgaattcgcttcgaaggatattcttgagccttacttggatagtctattgacaaatttattagttttattacaaagcaacaaactttacgtacaggaacaggccctaacaaccattgcatttattgctgaagctgcaaagaataaatttatcaagtattacgatactctaatgccattattattaaatgttttgaaggttaacaataaagataatagtgttttgaaaggtaaatgtatggaatgtgcaactctgattggttttgccgttggtaaggaaaaatttcatgagcactctcaagagctgatttctatattggtcgctttacaaaactcagatatcgatgaagatgatgcgctcagatcatacttagaacaaagttggagcaggatttgccgaattctgggtgatgattttgttccgttgttaccgattgttataccacccctgctaattactgccaaagcaacgcaagacgtcggtttaattgaagaagaagaagcagcaaatttccaacaatatccagattgggatgttgttcaagttcagggaaaacacattgctattcacacatccgtccttgacgataaagtatcagcaatggagctattacaaagctatgcgacacttttaagaggccaatttgctgtatatgttaaagaagtaatggaagaaatagctctaccatcgcttgacttttacctacatgacggtgttcgtgctgcaggagcaactttaattcctattctattatcttgtttacttgcagccaccggtactcaaaacgaggaattggtattgttgtggcataaagcttcgtctaaactaatcggaggcttaatgtcagaaccaatgccagaaatcacgcaagtttatcacaactcgttagtgaatggtattaaagtcatgggtgacaattgcttaagcgaagaccaattagcggcatttactaagggtgtctccgccaacttaactgacacttacgaaaggatgcaggatcgccatggtgatggtgatgaatataatgaaaatattgatgaagaggaagactttactgacgaagatcttctcgatgaaatcaacaagtctatcgcggccgttttgaaaaccacaaatggtcattatctaaagaatttggagaatatatggcctatgataaacacattccttttagataatgaaccaattttagtcatttttgcattagtagtgattggtgacttgattcaatatggtggcgaacaaactgctagcatgaagaacgcatttattccaaaggttaccgagtgcttgatttctcctgacgctcgtattcgccaagctgcttcttatataatcggtgtttgtgcccaatacgctccatctacatatgctgacgtttgcataccgactttagatacacttgttcagattgtcgattttccaggctccaaactggaagaaaatcgttcttcaacagagaatgccagtgcagccatcgccaaaattctttatgcatacaattccaacattcctaacgtagacacgtacacggctaattggttcaaaacgttaccaacaataactgacaaagaagctgcctcattcaactatcaatttttgagtcaattgattgaaaataattcgccaattgtgtgtgctcaatctaatatctccgctgtagttgattcagtcatacaagccttgaatgagagaagtttgaccgaaagggaaggccaaacggtgataagttcagttaaaaagttgttgggatttttgccttctagtgatgctatggcaattttcaatagatatccagctgatattatggagaaagtacataaatggtttgcataa

SEQ ID NO: 312 - DNA, 351 bp, Saccharomyces cerevisiae
atgacgctacgagctataggtgaatcttcgccaccgccaagatcagcatgtaattcatcacagctaatatttttagtagtaaatcttaaagtacctgcagttggattagaattattcttattagtttgggagagttggttgacatattcaattaaggaatcatcgcttaacgtagatagaaaagaccttgcattcaagccgccggtctttgctgttaaatgtgaatcattgacactttgctggctaaggcaattgtttttatcaggtgtttccctatttatagagtattccaaatcgctgtccaataaatctacaagaccaccatgttcacccatcgctggatatgcctag

SEQ ID NO: 313 - DNA, 1146 bp, Saccharomyces cerevisiae
atgaattataataactttgaaaattcgaagggtgatggacattctaggcttcccaaacctacatactccggaacgctatcagatggctatgatgaatcgaaaattaaaaggcaaaaaacagactctgcttttaatgcagcttactcacctcatatgtatccgaactctccgtattatgaaggttcatggaataccggttatactcctcaacttcatcatgtagcccctcataatcaatatttccatccaatacaaccgtccactcagtacaattatacgagtcctcccaattatacagaaaattacataccgccagttcatcagaatatatcttatgcaccagcgcttaatttacagaagtggccatcatcatattgtgaaaacactcaagccttaaagaatgataaagattaccaaacatcaattagttatgaagatgttgcaataccgaccgtaaaggaaatacaattgattgagaaaaacagagggaaagatacgtttatgaatgaaataagtccagtaccatcaagcaaggatcaagcatctgcggagcctacagaaatcccaagaaaggatcccgagctggcaaattctaatgccgaagatgatcataataacttagggctagaagatgatgatcgtgatgagcagttagaatcagaggggttgggtaaggtggttttggttcctggaacctccatagcattgattactgatgaagatgttaaaaagtggagagaagaaagaaaaaaaatgtggctactgaaaatatccaataacaaacagaaacatatgcaagaaatgggcataaaggaagatgaactgaagagccaacctagcattttcaaagagtcaaggaaagaaaagcaatttatacagagtattcaaaatcaagtgcagagaggaaatccgaagattgacttgaacttgaaattgatacagcgagaattcgcaaacgaaaactcccaacttttggactttataagagaattgggagatgtaggattacttgaatatgagctatctcaacaagaaaaagatgtactttttgggagctctgaagataataataaaaatcattacaaaccaaattacaaaaacaggaaacctaatctgagtagagccaactttactagaaataagtaa

SEQ ID NO: 314 - DNA, 609 bp, Saccharomyces cerevisiae
atgctaaattataaattgattttattgttttcctctttcctacaattaatctctttttctggctttatgatatgttgtttaacttcaccaataattagaaactgggggctggctcaagctgctggagtttcatatggtacctttggttactgtaaaactttgaattctttttcctgctctcgagtacgtttaatatataacacctcgaaagaaatattacctggcccttctcttgaacgttggtggctgagtcctaaggcaagacatacaataggaggacttttgatttcgataccggttgctacatgtttgactttcatttcttttgcacttcccttggttattatttttctttttcagactggaggaactaatgtctcacttattacttccaacgctatattacacatattgacacttttatcaactatttttgcatgcaccgtgatcctgttactttgcatgcaccgtgatcctgttacaatttcatccttatacgacttggtgtggctggctaactgttccctgttccctctgctcgttattggcgtgcattttctcagttttaggtttgatacgtctgcgcagtcagacagaaaacatagctaa

SEQ ID NO: 315 - DNA, 345 bp, Saccharomyces cerevisiae
atgtatcctttctataaatatatcttttctttttggtttttttttttggtcgaatatgtcgtaacttttcgactttttttatccttgaagtctggaaatatttttctaagtacccaacagaggtttaaagatgctactaagatgtgttttcaccaccaaatgctttcctcgagtgtcgaacctttcttctctttgtatttcaaccacgttccatatatgtggtcgtgtttcaactttttttcttcgtctccttttcctcgttgcaccaaaaattctccagaaaaaaagaaattcaaacgtgggctgcctattagtagtaaatacacagacgggaagaagcgttga

SEQ ID NO: 316 - DNA, 675 bp, Saccharomyces cerevisiae
atgtgggattcgttaattgtaagcatcaacgatacgcacaagttggggctggaggattgtctcgccgtttttggccacgttcccattaccaaggccgtcaagcatgtcagactgacagagatcgacacgcagacgtccacgtttacgctcaagttccttcacacagaaacgggtcagaacatcgagaagattatctacttcattgacaatgacacgggcaacgatacccgcactgctaccggaatcaagcaaatcttcaacaagatgttccgcatcgctgcggagaagaggaagctgtcgctcatccagatcgacactgttgagtacccctgcactctagtagacttgttgatcctggtaggcgtggcgctaccgccattgtgctacctctatcgtcctgcactgcacgctatctttttcctggtccctaatcctgtgggctccaccttagaggcgtggctggatagtgatcttgtgctgcgactcatcattgttgccgagttcctgactcacgccctcgagacgctcattttcgtcgtccctaggctcaagtactaccgtgttcctggcgagttcgtgcccgagtggcttcttctaggtctcctcgaaggttacggtcctgcgagacgtctagatactaaggctcgcactcttggcgaagggtcagttaattag

SEQ ID NO: 317 - DNA, 1452 bp, Saccharomyces cerevisiae
atggtaacacagaccaatccggtccctgttacatatccaacggatgcttatatccccacgtatctgcccgatgataaggtctccaatctggcagatttgaaaaaattgatagaaatggattccagactagatttgtatctgacaagaaggaggctggatacgtccatcaatttacctacaaacaccaagaccaaggaccatccccccaataaagagatgctgaggatttacgtctacaacactacggaaagcagccctcgcagcgattctggcaccccagcggactcaggcaagactacatggacactgagaatagaaggtaagcttctgcacgagtccgcaaacggaaagcacccatttagtgagtttttggaaggtgtcgcggtcgactttaaaagactgaaaccgctgggcatgggcaagaagaggaaacgcgattcgtcattgagccttcctttgaatctgcaacaacccgaatacaatgatcaagatagcaccatgggcgataacgacaacggcgaggatgaggacagtgcagaggcagaatccagggaggaaattgtagacgcactggaatggaactacgatgaaaacaacgttgtggagtttgatggtatcgacatcaagaggcaaggcaaggataatttgcgatgcagtataaccatccagttgaggggtgtcgacggtggaaaagtacagtactcgcccaacttagctaccttgataggtatgcaaacgggctccgttaatgacgcggtttattcgatctacaagtacattttgatcaacaatctgtttgttacggaacaaacagaggctcaagatggttccaacgatgccgaagacagcagtaacgagaataacaataaaaacggtgctggtgacgatgatggcgtcgagggaagtactccaaaggataagcccgaattgggtgaagtgaagctagattcactcttacaaaaggtattggatacaaacgccgcgcacctccccttgatgaatgttgtgcaaaccgtgaacaaactggtatcacccctaccgcccatcatcctagattatacaattgatctttccaaagataccacctatggtgctaccaccttggatgtagatgtgtcgcacattctccaccagcctcaaccccagccaaatttacaaaaagaggaagaaacagatgctgaagacacagcaaaactacgtgaaatcacaaagcttgccttgcagttgaactctagtgctcaaaaataccagtttttccacgaactgtctttgcatccaagagaaacgctgactcactacttatggtcttccaagcaaaacgagcttgtgctgcagggcgaccaatacttcaatgaagatgctgcaagaacgagtgacatatacagtaacaacaacaatgacaggtcactaatgggcaatatctcactactgtactcccaaggaagactataa

SEQ ID NO: 318 - DNA, 2157 bp, Saccharomyces cerevisiae
atgggatccgaccggtcgtgtgttttgtctgtgtttcagaccatcctcaagctcgtcatcttcgtggcgatttttggggctgccatatcatcacgtttgtttgcagtcatcaaatttgagtctattatccatgaattcgacccctggttcaattatagggctaccaaatatctcgtcaacaattcgttttacaagtttttgaactggtttgacgaccgtacctggtaccccctcggaagggttactggagggactttatatcctggtttgatgacgactagtgcgttcatctggcacgccctgcgcaactggttgggcttgcccattgacatcagaaacgtttgtgtgctatttgcgccactattttctggggtcaccgcctgggcgacttacgaatttacgaaagagattaaagatgccagcgctgggcttttggctgctggttttatagccattgtccccggttatatatctagatcagtggcggggtcctacgataatgaggccattgccattacactattaatggtcactttcatgttttggattaaggcccaaaagactggctctatcatgcacgcaacgtgtgcagctttattctacttctacatggtgtcggcttggggtggatacgtgttcatcaccaacttgatcccactccatgtctttttgctgattttgatgggcagatattcgtccaaactgtattctgcctacaccacttggtacgctattggaactgttgcatccatgcagatcccatttgtcggtttcctacctatcaggtctaacgaccacatggccgcattgggtgttttcggtttgattcagattgtcgccttcggtgacttcgtgaagggccaaatcagcacagctaagtttaaagtcatcatgatggtttctctgtttttgatcttggtccttggtgtggtcggactttctgccttgacctatatggggttgattgccccttggactggtagattttattcgttatgggataccaactacgcaaagatccacattcctatcattgcctccgtttccgaacatcaacccgtttcgtggcccgctttcttctttgatacccactttttgatctggctattccccgccggtgtattcctactattcctcgacttgaaagacgagcacgtttttgtcatcgcttactccgttctgtgttcgtactttgccggtgttatggttagattgatgttgactttgacaccagtcatctgtgtgtccgccgccgtcgcattgtccaagatatttgacatctacctggatttcaagacaagtgaccgcaaatacgccatcaaacctgcggcactactggccaaattgattgtttccggatcattcatcttttatttgtatcttttcgtcttccattctacttgggtaacaagaactgcatactcttctccttctgttgttttgccatcacaaaccccagatggtaaattggcgttgatcgacgacttcagggaagcgtactattggttaagaatgaactctgatgaggacagtaaggttgcagcgtggtgggattacggttaccaaattggtggcatggcagacagaaccactttagtcgataacaacacgtggaacaatactcacatcgccatcgttggtaaagccatggcttcccctgaagagaaatcttacgaaattctaaaagagcatgatgtcgattatgtcttggtcatctttggtggtctaattgggtttggtggtgatgacatcaacaaattcttgtggatgatcagaattagcgagggaatctggccagaagagataaaagagcgtgatttctataccgcagagggagaatacagagtagatgcaagggcttctgagaccatgaggaactcgctactttacaagatgtcctacaaagatttcccacaattattcaatggtggccaagccactgacagagtgcgtcaacaaatgatcacaccattagacgtcccaccattagactacttcgacgaagtttttacttccgaaaactggatggttagaatatatcaattgaagaaggatgatgcccaaggtagaactttgagggacgttggtgagttaaccaggtcttctacgaaaaccagaaggtccataaagagacctgaattaggcttgagagtctaa

SEQ ID NO: 319 - DNA, 3660 bp, Saccharomyces cerevisiae
atggctatcttaaaaagaggagctagaaaaaaggtacatcaggagccagctaaacgctctgcgaatatcaagaaagctacttttgattcctcgaagaagaaagaagttggtgtgtctgatctgacgcttctttctaaaatctccgacgaagccataaatgaaaacttgaagaagagatttttgaatgctacaatctacacttatataggtcatgtgttaattagtgtcaatccattccgagacctcggaatctatactgatgctgttatgaatgaatacaaaggtaagaatagattggaagttccaccccatgtatttgcaattgcagagtctatgtactacaacatgaaatcatataatgaaaatcagtgtgttattatttcaggtgaatcaggtgccggtaaaactgaagcagctaaaagaattatgcaatatattgcggctgcttctagcacacatacggagtcaattggaaagattaaagacatggttttagccactaatccattgttggaatcttttggctgtgcaaagactctaagaaataacaactcttctagacatgggaaatatctagaaataaaattcaataaccagtttgaaccatgtgctggtaatatcacaaactatttattggagaagcagagagttgtgagtcaaattaagaatgaaagaaatttccatatattctatcagttcacgaaaggtgcttccgatgcttataggcaaacatttggggtccaaaaaccggaacaatatgtgtacacagctgctgcgggttgcatatctgctgagacaattgatgatttgcaagattatcaagagacattaaaagctatgagagttattggtctcggtcaagaagaacaagaccaaattttcaggatgttagctgcaattctttggattggtaatgtttcctttatagaaaatgaggaggggaatgcgcaagttagggacacctcagtaaccgattttgttgcttacttgttacaaatagatagccaattgctgattaaatcacttgtggaaagaattatggaaaccaatcatggtatgaaaagagggtcagtgtatcatgttccattgaatattgtccaagcagatgcggttagagatgctttggcaaaggctatttacaataacttatttgactggattgtgagtagggttaacaaatctctgcaggcttttccaggcgctgaaaaatccattggtattcttgatatttacggctttgaaatttttgaacataactcttttgagcagatttgtatcaattatgttaatgaaaagttacaacaaatctttattcaattgacattgaaatctgagcaagaaacttacgagagagaaaaaatccaatggaccccaattaaatactttgataacaaggttgtgtgtgatttgattgaggcaagaagaccacctggtatatttgcagcaatgaatgattctgttgcaactgcacacgcggattcaaatgctgctgatcaggcttttgctcagcgtttgaacttgttcacaacaaatccacattttgacttgagatctaacaagtttgttattaagcattatgccggtgatgtcacatacgatattgacggtattacagataaaaataaggatcaattacaaaaggatctggtagaattaattggtaccactaccaatacatttttagccaccattttcccggatactgtagacagagaatcaaaaagaaggccacctacagcaggcgacaaaattataaagagtgcaaatgatttggttgaaactttatcaaaagcacaaccttcatatatcagaacaattaaaccaaacgaaaccaaatctcctaacgattatgacgatcggcaagttctacaccagattaagtatctaggtctgcaagaaaacgtgcgtatcagaagagcaggttttgcatatagacaagtgtttgagaagttcgtggaaagattttatttattatctccacactgttcttacgctggtgactatacatggcaaggtgataccttagatgctgttaagtatatattgcaagattcctctatcccacagcaggagtaccaattgggtgtcacaagtgttttcatcaaaacacctgaaacattatttgctttggagcatatgagagatagatactggcacaatatggctgccagaatccaacgtgcttggaggagatttttgcaaagaagaattgatgcggccactaagatccagcgcaccatcagggagaggaaggaaggtaataagtatgagaagctccgggattatggtacgaaggttttgggtggaagaaaagaaagaaggtctatgtccttattaggttacagagccttcatgggtgattatctatcatgcaacgagtccaaatcgaagggcgcttatatcaaaagacaagtgagcattaaagagaaggtcatcttttccatacatggtgaggccttgcatacaaaatttggccgttctgcacaaagattgaaaaaaactttcctattaactccaactacattgtacattgttggtcagactttggtccaaaatgctatgacctatactcaggattataaaatcgatgtgcgaaacattcaagcggttagtttaaccaatttacaggatgattgggtcgccattaagttggctagctcaggtcaacctgaccccttaatcaacacatatttcaaaacagaactcataacgcatctgaaaaggcttaacgacaaaattcaaattaaaataggctcggcgatagagtaccaaaagaaacctggaaagttgcattcagtgaaatgtcaaatcaatgaatctgcaccaaaatatggcgacatatataaatccagtacaatatcagttcgtcgtggtaacccacctaattctcaagtgcacaaaaaaccgagaaaaaagagttcaatctcttcaggatatcatgctagttcctcgcaagcaacgaggaggccagtttcgattgctgcagcccagcatgttcccaccgccccggcttctaggcattctaaaaagcctgcccctccaccaccaggaatgcagaacaaagctgctacaagaagatctgttcctaatcctgcttccactctcactgcatcccaaagtaatgcccgtccttctccccctactgctgccactcgtgctacacccgctgctacacccgctgctgccgcaatgggctctggtagacaggcaaatatccctccaccacctcctccacccccaccctcttcaaagccaaaagaacccatgtttgaagcggcttacgattttcctggttcaggatcaccatctgagttacctttaaagaaaggagacgtaatttacattacaagagaagaaccaagcggttggtctctcgggaaacttctggatggctctaaggaaggttgggtgccaacagcttacatgaaaccacattccggaaataataatatccctactcctcctcaaaacagggatgttcctaaacccgttctgaattctgtacaacatgataacacctctgcaaacgttattccagctgcagcccaagcaagtttgggtgatggtttggcgaatgcgcttgctgctagggccaataaaatgagattagagagtgatgacgaggaggctaacgaagatgaagaggaagatgattggtaa

SEQ ID NO: 320 - DNA, 1746 bp, Saccharomyces cerevisiae
atgtctaaacaatttagtcataccaccaacgacagaagatcatcgattatctactccaccagtgtcgggaaggcagggcttttcacgcctgcagactacatcccacaggagtcagaagaaaacttaattgagggcgaagagcaagagggtagtgaagaagaaccttcctataccggcaatgacgatgagacggagagggaaggtgaataccattcgttgttagatgccaacaattcgcggacattgcaacaagaagcgtggcaacaaggttatgactctcacgaccgtaagcggttgcttgacgaagaacgggacctgctaatagacaacaaactgctctctcaacacggcaacggtgggggagatatagaaagtcacggacatggccaagcaattggaccggacgaggaagaaagaccagctgagattgcaaatacgtgggagagcgcgatcgagagtggtcagaaaatcagcacaacttttaagagagaaacgcaagtgatcacgatgaatgcgttgccgctaatcttcacctttatcttgcaaaattcgttgtcactagcatctattttctccgtctcacatttagggacgaaagagctaggtggtgttacactcggttctatgactgctaacatcacgggtcttgctgctattcaaggtctgtgtacatgtctggacacactgtgtgcgcaggcatacggtgccaaaaactaccacttggtgggtgtgctagtgcagagatgtgctgtgatcaccatcttggcgttcttgccaatgatgtatgtttggtttgtttggtcggaaaagatcctagcactaatgattccggagagagaactatgcgcgctagcggctaactatctacgtgtaaccgcattcggtgtgccaggattcatcctttttgaatgtggtaagaggttcctacaatgtcaaggtatattccatgcatccacaatcgtgctctttgtgtgcgcacccttgaacgcattgatgaactacttacttgtttggaatgacaagattgggattgggtaccttggtgcgccattatcggttgtgatcaactactggttgatgacgctcggattactaatatacgcaatgaccaccaagcacaaggagagaccactcaaatgctggaatggtatcatccctaaggaacaagcatttaagaactggcgtaagatgattaacctagctattcccggcgtggtgatggtggaggcagagttcctcggctttgaagtgttgacaattttcgcttcccatctgggcaccgatgccttgggcgctcagtcgattgtggctacgattgcgtctcttgcataccaagtgcctttctctatctccgtttctaccagtacacgtgtagccaattttatcggcgcgtcgctatacgacagctgcatgatcacgtgccgcgtgtccttattgttgtcctttgtgtgctcctcaatgaacatgttcgttatctgccgttataaggaacaaatcgcaagtctattttctactgagagcgctgtagtgaagatggtcgtggacacactacctcttcttgcgttcatgcaattattcgatgcctttaatgcgtccaccgccggatgcctacgtggtcaagggagacaaaaaaataggtgggtacatcaacctagtcgcattctactgcctaggtgtgcccatggcatatgtgttagcattcctgtatcatctgggtgtaggcggcttatggttgggtataactag

SEQ ID NO: 321 - DNA, 324 bp, Saccharomyces cerevisiae
atgcatactatttgccttagaagcccgatcgatgaatcctctcctcttccatataaatcaataaggcaacctctagaaaacgcccattcctgccaagcgctttgcagccttatggccgtactctgtgcatccgctgctcatcggctctctgaaaccttccctatgcgtttggtagtcgcgcgtgaatatgctaattggggcgccttccaacatgcgtttacgcggcgcgctggagcttctgtggcggcgacttctgcatggtttgatgcagttgcggctggtactgaaaatgcacatatgcagtcagctgaatcatgcaattaa

SEQ ID NO: 322 - DNA, 2280 bp, Saccharomyces cerevisiae
atgacagcgccattgtggccaaacaagaatgaaaaaaaccacacagttaaaagagcgttatcaacggatatgaccagcaatattttgagtagcacaaacgcgagctcaaacgaagaaaattctaggagttcttctgcagccaatgtacgctccggaacaggtgcaaatacacttactaatggcggcagtactagaaagagacttgcgtgcactaattgtagaaatagaaggaaaaaatgtgatttaggatttccctgtggtaactgttccaggttggaattggtttgtaatgttaatgacgaggacttaagaaagaagcggtacactaataaatatgtcaagtctttggagagccatattgctcaactggagaccaacttaaaaaacctagttcagaagatctaccctgacgatgagcaaatactgaaccgaatgatggtaggtgatgtattatcagctctaccagacagttcacaagtctcaatcaattatactgaccaaactccctctcttccaattcccgcaaccagaggtacattcattattgaaaacgataaggtcagtcaacctctatcgtcctttaaccaacaaacagagccatctactctaaactcgggtatcttcaacacccaaaaacaaaatttcgaagaatcccttgatgatcagttacttttacgaagatcgttaacaccgcaaggtgaaaaaaagaagaaaccgttggtaaaaggtagtctttatcctgaaggacctgtcagttacaaacggaagcaccccgtaaaatcggacagtttattgcctgtgtcttcgttaacagctgctacagacccatctactttttctgacggtataactgctggtaattccgtcctagttaatggtgaactgaaaaaacgtatatccgacttgaagaccaccgtaatagtaagaggactaaacgatgataatcccaactctatcaataacgatcccaggattttaaaatctctttccaatttctataagtggctgtatccaggttattttatttttgttcacagagaaagttttctttatggattcttcaatcactccaagaataactatgaagactcaagttactgttctgtcgaattgatatatgccatgtgcgctgtcggttcgaggcttacaccggatctacaagaatattcagaagtgtattatcaacgaagtaagaagactttattacagctcgtctttgatgagcaaagtacagcccgtatcaccaccgtccaagcgctattttgcttagccttttacgaactggggaagggtaataatcaattagggtggtacttctcgggcctggctatcagggtcggctacgacatgggatttcaactggaccctaaagtctggtacgttgatgataacaatctgcagctgacccaaagtgagttggaaataagatcaaggatttactggggttgctatatagcggatcattttatttgcctgatgttgggtagaacgtccacattaagcgttagtaactcaaccatgccagagtcggatgagctgccagaagtcaacggcaccgaagagttcagatttattggaagacatgttttacagatatccttgcctctgaaaaacttgataattctatcaaggcttgtacaaatcttcacctctaaaattttcatcgagtcggaagatatagcacgaaaactaaagtacttgaacactttcaattctcaggtttacaactggagacaatctctaccggaatttttgcaatggtcgaaaacactcatcgagaacgatgacgtatccacagaccccactatatcttacttctggtattgctactacatagtgcggctcacctttaacaagccatttatagaagactctcaagaatccgaaacggtagtcatagagatcatcgatgatttgaagactttgctggacaatttcgggaaaaaattcggaaactacacgaagggaaacctttaccaactttactcatgcctgttggccatcaactgtttgaagaagttgaaagagatacgttccagtgagcaagactcatggaatgcacaattggattttttcaatcacatcttctacacacaactatatcccgcatatgatctgccgaaaaagctgcaggaggatacggagctggaaacagaacaagaaaaccagatgttgaaccaagttggaaatataaactacacgcacgatttttcactctcccacgaaattgacgatcttatcagagaactgtttggggtgggcacacctcaaaaactctga

SEQ ID NO: 323 - DNA, 1023 bp, Saccharomyces cerevisiae
atgattgatcgtaccgagttatcgaagtttggtattactacgcaactgtctgttattggacgtaatccagatgaacaaagtggctttgttaatccacctttgtataaggggtcaaccatcattcttaaaaaacttagtgatttagaacaaaggaaaggaagattttacgggacagcaggttctccaactattgacaatttagaaaatgcctggacgcatttaaccggcggtgctgggacagtgctatcagcttctgggcttggttctatctctttggcgctattggccctttcgaaagctggtgatcatatcttgatgactgatagtgtctacgtgccaacacgtatgctatgtgatggtttattggccaagttcggtgttgaaacggattattatgacccatcaatagggaaggatatagaaaaactagttaagccaaatacaaccgtcattttcctcgaaagcccgggttctgggaccatggaagtacaggatattccagctttggtctctgttgccaaaaagcatgggataaagacaattctagacaacacatgggcaacgccactcttttttgatgctcatgcgcatggtatcgatatttcggtagaagctgggacaaaatatttgggtggtcattcagatcttcttattggtctggcctccgcaaatgaagaatgttggccgctattacggtcaacttatgatgcaatggcaatgttaccaggtgccgaggactgtcaattagcattgcgaggaatgcgtacattgcacttaagattgaaagaggtagaaagaaaagccctggatttggctgcttggctcggaaatcgagatgaggttgaaaaagtgcttcaccccgcctttgaagattgtcccggacatgaatactgggttcgtgactacaaaggttcttcaggcttattttccattgtccttaaaaatgggttcacaagagctggtctggagaaaatggtagaagggatgaaagttttgcaattgggattttcatggggtggctag

SEQ ID NO: 324 - DNA, 336 bp, Saccharomyces cerevisiae
atgtcaaaaaccgatgtcaaaaaatctcgtgaggcctccggaattttgacgctgcaagtcaatctacgggaaagaagaaattttttaaacttaatgcaaaataagcttttttcttggaaaataagattttcggcaataaaaggtaaatgcagccaaaaatcaaaatacttcagaagaagtcgtagcgaggactgctacgtggaagcggatttgaagatcctttccagaacaagaaggagccgaaagctgccaggaactgttcctgattttttaggaaaacaattaataggtatctcgtctagcgtagtatctcgagtttccagaagttgcagataa

SEQ ID NO: 325 - DNA, 2589 bp, Saccharomyces cerevisiae
atgaacatggcaatccaaacaattaaatacattttttggctactgccgatattagggcttacacaagcacttctacaaaacccaggggacgattttccatttagcacagtaatagatatcctctcagaaaatgttgaattctcaacttttttaaggattattcagaaaactggtcacgtacagtacttaaatgagctacagaactttacactttttgctccgattaattcagcatttattaagggggaccaaaccacagaccaatttgaggagcatttccatattgaagatttccttattcatgatagggtattgcaagtgagagaccttgaaaacggtacctacctggagaaaagagctgcaaaagcacctttattgctgagaaagcatgagcgccattgctttgtcaatgaaattgctgttgtcgaacccgatttgctgcctagtttccagaatgcttcattacaaggtattaacaatcttttactaattcaacctcaaataaatgagttgctggtacaactagatgaagaaacccaagatttaaagatatttagtgattttatcagcagtttttcaaactataatgcatatacaaactcatccacagttttagtgcccttagatgttaattttcgaaaattcttcaatacaatcgaaataaactatctacttgacaaatataataaattgggtaaatctaatacaatttctcaggccaaatgggccgcagatagaacttcccttcttcaagaactcattattgatgacgtgtatggtggtattttacccaaggaactaattttagaaaataaaaacaatcgaaaactttttatgaagagtaattcagaaggtacatcagtaagtgtaaataattcagattactcacccatatcaaacagaatttttgaaataggcgtcgtgcatggattttctgacttagactttttacgaacgcatatacagtttgatgctgaaaagtacttgcacggtttgaactgctcagaattcgtaaaggagttatacttcagagaccttgaaaaattcattcaaaacggaaggaaaatcaccatatttgtaccacaagcctcttttaatgaggatcgtgggtacacaaaaccatcacttctgtaccattttgtagaaggtaaaattgaccttgaacaggacttttcctcattgcgcccgattcaatacgcacctacccaaatttatgactccgccttttgctcttcagctaaaagactaggtggacactgccaaaagttcaaaatcacaaggtctaataaaggttattacatcaatggtcgcttcaagattttaaacacaaaaccttatgagattggtaatacgtccatttattctattgacgatgatcttcaattaccgggcgacttagtgttgtcattagcaccagaaaaccactgttctatttccctaatgctcttgaaggaacttaaccttttggatctaccatcaaatcataaggggtacacgatacttcttccatgtatgaattcatgggacaataatgatttgactatagactatttgaggtcaaacaaaaccgccctaaatttacttatgaggaacctaatcttcgaagaccttatttattccaacaattatagtatttcgactactgtcaagaatttatacggaaattctgtatctattggcgtacaaaaaattgtgggaagccaaaaccttacgaaaatctcagtgagtactataaaggaaagtattattattgaggagagttccgatatatttttcaaccagggagttatccatcctatagaccaattggattttccagtcgatttggagatatccctaaaagagctgatagaaactactggaacaaaagaaatatttgacttttttaacttgttttatgacctttcttcaatcatttggaataacgaagagtactcgcttttagttccaacggcttcttctattccattaagtggcatcacggcgaactcgacaaacttaagaaaattcctcgaactccatttgattcctgctaatgtaacgcaaaacctactagactgcaatggctccattagcactaaactaggtacaaaactaaactgcagaaaagatcatctggacaacgtttttgttagcatacagggcgactggaccaaggaagttagagttcttaaaacaggatgcactactaatttgaaaagttcatgcatatttctgatcgacaaacccatatccttatcttggctaaacagcgagaaataccatctgcgcttgccagggatagcggttggatttggggttataataggtgttaccatagccatttctttattgttttgcataataattaccaggggtggaaaagtaaaagacaaaaatcaaagagggagaaatgatcgagcaacaacaccactgattcaacactctccgataatccacaacccttcttactcggcaacagcgcatttatcaccactttctcaacccacttttgaaggttcatattctgtgaacgctatacaaacccccagagatatacgaagggtgggatcagatcaaaagggcggtcgcagtgtcagtacctcataa

SEQ ID NO: 326 - DNA, 2250 bp, Saccharomyces cerevisiae
atgaccagtatgtcaattattgatgatgagaacgtgaaaaaaacttctaatggggcagctgttgtcactgatgtggctcaacacgctgtaagtgattcggacaataacaaagcgcaacttctaggcgatggatccaacactgaatatgtggttgatattttcattgaagccgctaaggatggggatttaaaagtggtgaaggacgtggtcgaaagtggagcagtggatattaataacgaccgcattgatgaattatccggcttacactgggcctgtataaacaataggttttctgtagcaaagttcctattacttaggggagcaaatcctaaccaggcggcaggccccggaggggctactgctttgcactgggccgcaaggtacggtaatatctacattgttgacctgcttctcaaacatggcgctgatccgacgctcaaagatgagcagggtcttaacatcatgcattttagcgtttacagttctaacattttacttgttgtttatgttctttattttgtcgtaaacaacaatgacaacgtcgatatcgattcaaaagataacaataacagaacacccctactttgggctgcttatcaaggagattttctcactgtagaacttttattgaaatttggctccacagttgcatggacggacaacagagggttcaatgctctccattgtgctctagttggaggtgatcaaagggtcatatgtgacttaatacttagcggtgcaaatttctacgaaaggaataaccagaagcaagactgttttgatctagccgaaggaatgggaaccaaatcactttttgaacaagcgttgcaacatcatggatatgacaggcttggaaatcagaaagacaaactgttcaagaaaagctcgcatgcacaattcacaatttttttgtcaccatttttactcatggtttacatatacttaatttctctcgttctttctccagtgctagccattatgctttccctactggtcactgttgtcatggtcaacacattaaagaagtttgtattaccatgccttcccagaaaaaacacttacaaagtttctttgactagaactccctttttcagtggcctctttctgtccactttctgttttttaatatatatatggacgaagaaactctatccatatagtgtatctgactataccatgaaaaacgtccagtttttggttacttcctttctcacagttgtactatttctgagattagtacggtcagatcctggttgtctgaaaacggatgatagtttgacttcgatacaagaaacaataaaacaactgattgacttagggaagtttgatagggaaaacttttgtgttgagacattagaaaggaagcctttgaggagtaaatattctttctttagcggcgccctggtggccagatatgaccattattgtccatggatttataatgatgttggcttaaaaaatcacaaactttttgtcttctttgctgtgacggtccaatatcacatgtttttgttcatgtggttatgtctggcatattttaagaaaacgaactatatttacgaacaagttgaagaatatgcaagatgtgccctgctcaagaatgagactttgtgtaagggttctaattacgatccctctaccttttttttattcatttggattagcgtaaacttcatctggctgggggctatgttgattgtccagttcttccagatattaaaaggaatcacgactcctgaattgttcatcttaatcaaggaggagcacaaggcaaaatttatcaatctgatacccttcgaaaactctatatataccagtgaaagtaaaggtgttgaagatagtgatatgattcctgaaggtccaagtgcgaccaccattactcacacaatttctattgatggtttggaaccaagaaataggcgccgcgccattcttagcgcttgcttttcaatgatgggtattaatcaatggctcgttactattaaggaaatagtaggtataacccacattttgcatggacaggttccacaacaacatcacagttcattgcttcgaagtttcttagtgacaaatcactggaagacgaatttgacggatttttggcttaatagtgatgtaacagcgcccttgtggcaacgatttttctattcttcggatacttcaaaagctatgttgggtggaactgaggttgactactacgagctatacgaatatccggcccgagaaggagaagtattacgtccaaactaa

SEQ ID NO: 327 - DNA, 375 bp, Saccharomyces cerevisiae
atgaaatacaacgccaccaaggcaataagcatcgcaccacctacaatacccacggtgaaccccacaatcaacgaggttttctcatttgaattactggaactagaactagaggaggaggaagataaactactcagttgtgaatcggactgtttcgcacagtatgtggatgggcacttgtcacatgttaatgaagtcataacacaatattctcctgaagcgcaaacagggcatgatgcagttgaatcgcaaacaacacatccgtcgctgcctctagttgcagaagttgaagaggtggctgtgcttgacaaggatgaacttgcagaagccttggaggagctcgacattttttgtttgattttcagaaaacgaacgtaa

SEQ ID NO: 328 - DNA, 921 bp, Saccharomyces cerevisiae
atgatgaaaaaaaaaccaaagtgccaaattgcaaggaccaaaccatcggtcgaaaacgtcataccatataaccaattcaagaagacgcagccgcgattcaacggcaacttttctgcactgaataatgaagaatacataatactctttggcggaggtcgggacctgatactaggctccctgacaccttgttcgagctctcatttgtccaatcaagccaacccacaagacaccagtgagtatggcacagacctgtttatactcaacagctgcattatcatttggttcaatggcttgggatatgggctggaaattccctacagcagcgttttgtaccatgcatcaagacggctaccagatggtagggaagggcttcaattagaaattttgctgactttggaaagagacgaagtgttggacatgctctaccaaagcctcgcgccacaggcctgcgaattcgacggcgaagaagcacatgccttcaccgtgcgcagcgtggaattgactatcaggcccaaatattcaatatacgatcgccattataacaacgaaatcgaaacccttttcaccttcgaaaacttcggcgtgaacaggggcgatgacctggtaaacaattgtaacgaagcactagccgtatgcatggacctgcacggtgaggacgtacaagatcaagaccaggaacaataccaagatccaagcatggcgtttgagggtgcgcaagatctcaacgccacgtattctgggcttggagacacccttcacgggccgcccgtgtatcagaacgacgggctggcagacgatctggatggcgacctcgttatggacaacgtggtctctaggggtggtccagaagcaagtatgtctatggagttctacgcaaatcaaaatcttgctggcagaaagaactccagagacaatgaatga

SEQ ID NO: 329 - DNA, 1302 bp, Saccharomyces cerevisiae
atgattgtggggttgacactttattttgtattattccgttcaatacagtatttactggtttttttgactccaattaggcagtttgatacatcaacatcacttttattaaacgaattatgttcttctccctctgaaatcaacagttattggaacaagtatttttggaataagctactatcatgggacagtgttttttttatcaagaacataacttccaaaaacggaaaacctcaatttgagcatgaatacgcgttttctcagttgtggacttttttcgttaggctgtttattaaaagtaataacgatagcatctaccatgccttaagggttggagttgcaatagaaaatgttttattttacttgtcaggtattgttttatattttctaacaaaaaaaattttcagccaaaatataaggcaatcacagtttgctagaactatcgctaaaaaaacatctctgttgtttttcttaacgagtgccgctggatttttaacaagcatatattctgaaccattatcttttttttttgcatttgttggtatttggagtcgtgaatgcaccatttccgtgcccgtattgggtcaattcgatatttcgtggagatattggtttccttactcctttatcagcatggcttgctttaccttagcatccttgaatcgttcaaactgtgttttgttagggatttactttatttttgaccttattgaactaacaaagaacaggaagtttgtaaaagcaatatgtttcccactattatcaggatcattaatgttttctgctctactatatcaacaatattacctaccatataagacattttgtcctcaaaggggtgaatggtgtaaatctcaattgttttcaagcatttttatcacgaaaacttctttatattcctacattcagagtcattattggggagttgggttattgaaatactggaccccaaacaacatcccaaactttttgtttgctgtcccaaatattattattttaatctattcctccatatatttcagcaaaatttatccctcctataacttgaaggctctcgtatggatcaccagagcactggtcgtcatagtatgcttttttgcccatgtccaaattctgaatcgtatagcctcctttttacccttgcacctttggtatttggctgatagattggttaaaacttctgatccaaaaaaaatggaaaatccgaaaggtgacgataagatagtcaagttttacatatactggttggcattctggatacctttacagactatcctatttgcagcttttttaccaccagcctga

SEQ ID NO: 330 - DNA, 369 bp, Saccharomyces cerevisiae
atgtattcgatggcctttttggcttcctctggcttagtggcaaattcttcagcaacagtctttaagttgaacagagctctaaatctgttggccaaaactgttttgccggacttgttgactaagatgtcccttagttgctctagagtgcattcatcgacgttttcttggaaatgtttttcaaagttagtagacatgtttttttttttctttcttgcgtggtatgttagaaggactacagtttatcctaacctaaacctagagctaccgtcaaatatacacgtgtattcactggatttgccttatgtaatttatatgataaaaacttttcagctcatcgagaaaaattttctttcctcccacgcaggatag

SEQ ID NO: 331 - DNA, 2142 bp, Saccharomyces cerevisiae
atgactgccagcgtttcgaatacgcagaataagctgaatgagcttctcgatgccatcagacaggagtttctccaagtctcacaagaggcaaatacctaccgtcttcaaaaccaaaaggattacgatttcaaaatgaaccagcagctggctgagatgcagcagataagaaacaccgtctacgaactggaactaactcacaggaaaatgaaggacgcgtacgaagaagagatcaagcacttgaaactagggctggagcaaagagaccatcaaattgcatctttgaccgtccagcaacagcggcaacagcaacagcagcaacaggtccagcagcatttacaacagcaacagcagcagctagccgctgcatctgcatctgttccagttgcgcaacaaccaccggctactacttcggccaccgccactccagcagcaaacacaactactggttcgccatcggccttcccagtacaagctagccgtcctaatctggttggctcacagttgcctaccaccactttgcctgtggtgtcctcaaacgcccaacaacaactaccacaacagcaactgcaacagcagcaacttcaacaacagcaaccacctccccaggtttccgtggcaccattgagtaacacagccatcaacggatctcctacttctaaagagaccactactttaccctctgtcaaggcacctgaatctacgttgaaagaaactgaaccggaaaataataatacctcgaagataaatgacaccggatccgccaccacggccaccactaccaccgcaactgaaactgaaatcaaacctaaggaggaagacgccaccccggctagtttgcaccaggatcactacttagtcccttataatcaaagagcaaaccactctaaacctatcccacctttccttttggatctagattcccagtctgttcccgatgctctgaagaagcaaacaaatgattattatattttatacaacccggcactaccaagagaaattgacgttgagttacacaaatctttggatcatacttcagttgtttgttgcgtgaagttcagtaacgatggtgaatacttagccacaggctgcaacaaaactactcaagtgtatcgcgtttcagatggttctctggtggcccgtctatctgacgattctgctgccaataaccatcgaaattcgatcactgaaaataacaccaccacgtccacggataacaatacaatgacaaccactactaccaccacaattactaccacagcgatgacttcggcagcagaattggcaaaagatgtggaaaacctgaacacttcgtcttccccatcatccgacttgtatatccgttcagtgtgtttttctccagatgggaaatttttggcaacaggtgctgaagacagactgattagaatttgggatattgaaaatagaaagattgttatgattcttcaaggccacgaacaagatatttattcattggactactttccctcaggtgacaaattagtctccggttctggtgaccgtaccgttcgtatttgggacttacgtacaggccagtgttcattgactttatccattgaagatggtgttaccaccgtcgctgtatcaccaggtgatggtaaatacatcgctgctggttctctagatcgtgctgtgagagtttgggattccgagaccggattcttggtggaaagactagattcggaaaacgaatccggtacaggccacaaggactctgtttatagcgttgtcttcactagagatggacaaagcgttgtatccggctcattagatagatctgttaagctctggaatttgcagaatgcaaacaacaagagcgattcgaaaactccaaattccggcacttgtgaagttacgtatatcgggcataaagactttgtattgtccgtggccaccacacaaaatgatgagtacatcttgtccggttccaaagatcgtggtgtcctgttttgggataagaaatccggcaatccgttattgatgttgcaaggtcataggaattcagttatatctgtggctgtggcaaacgggtctccgctgggtccagaatataacgtttttgctactggtagcggtgattgtaaagcaaggatttggaagtataaaaaaatagcgccaaattaa

SEQ ID NO: 332 - DNA, 3108 bp, Saccharomyces cerevisiae
atgccagttgagtttgctaccaatccttttggcgaggccaaaaatgcaacttcactgccaaaatatggtacacccgtaactgccatttcatctgtgctgttcaataacgtggactccatttttgcttacaagtccttttctcaacccgatttgctacaccaagatctaaaaaaatggtctgaaaagcgtggtaacgaatcacgtgggaagccatttttccaagagctggatatcagatctggcgctggtttggctcctttagggttttctcatggattgaagaacactacagcaattgttgctccagggttttcgctgccatacttcattaactctttgaaaaccgtctctcatgatggtaagtttcttttgaatgttggtgctttaaactacgacaatgctaccggctctgtcaccaacgattatgtaaccgcattggatgctgcttccaagctgaagtatggtgtcgtgactccgatttccgctaacgaggtacaaagtgtcgccttactggcattggcgattgccactttcagtaataactccggagctatcaatttatttgacggattaaactactcgaaaaccgtcttgccgttggtcgaatctgttcctgaggcatctattttggcaaaactatccaaagttattgcaccagatgctgcctttgatgatgtcttggataagtttaatgaattgactggattgagactacataatttccaatactttggtgctcaggatgctgaaactgtgtttatcacttatgggtctttagaatccgaattgttcaactctgcgattagtggtaataattccaaaatcgggttaatcaacgtcagagtgccattaccttttaacgttgctaagtttgtcactcacgttccatccactaccaaacaaattgttgttataggccaaactttggatggttcttcgccttctttcttgagatctcaagtttcagccgccttattttaccacggccgcacctcaattagcgtttctgagtacatctatcaaccagatttcatttggtccccaaaagctgtcaaatcaattgtatcgtcattcatccctgaattcacttacaatgccgattcatctttcggcgaaggattcatttattgggcctctgataagagtatcaatattgatgttgcctccaaacttgtgaaagctctgtctttggaagatgggaaatttgtgtctttgagaacgaaatttgataacttggctaatgctggtaccttccaagctcaatttgtgacctcgaaagaacagatacctgtttcaaacatcgattctacgaaattatcagtcgttgaagatgtcagtttattgaagcatttagacgtagctgctaccgtcgcagaacaaggttcaattgcgttggtttcccaaaaggcagttaaagatttggatttaaattctgtagaaagttacgtcaagaatttgggaattcctgaatcattcctaatatctattgcgaagaaaaacatcaaattgtttatcatcgatggtgagaccactaacgacgagtccaaattgtccttgtttatccaagccgttttctggaaattggccttcggtctagatgtcgcagaatgtaccaaccgtatctggaaaagcattgattcaggtgcagacatttcagcagcctcgatttctgaatttctcactggtgcattcaaaaacttcctcagtgaggttccgctagcgctgtacactaaattttctgaaataaacattgaaaagaaagaggatgaggaagagcctgcagctttaccaattttcgttaatgaaacatctttcctcccaaataacagtaccattgaagaaataccattacctgagacctctgagatctctgatattgccaagaagttgtccttcaaagaggcatatgaagttgagaataaactaagacccgatttacccgtcaagaacttcgtcgtgaaagttaaagaaaatagacgtgttacgcctgctgattatgatagatatattttccatattgaattcgatatttctggtactggaatgacttatgacatcggtgaagccctcggtattcatgccagaaacaatgaatctttggtcaaagaattcttaaccttctatggtctaaatgaatccgatgttgtcttagtccccaacaaggacaaccaccatttgttagaaacaagaaccgtcttacaagcatttgtggaaaatttggatattttcggtaaaccaccaaaaagattttacgaatcattgattccatatgcctctaacgaagaggagaagaaaaaattagaggatttggttactcctgccggtgcagtagatttgaagagatttcaagatgtggagtattatacatatgctgacatttttgaattgttcccatctgttcgcccatctcttgaggaacttgttactatcattgaaccattgaagagaagagaatactcaattgcctcctctcagaaagttcatccaaatgaagttcatttattgatcgttgttgttgattgggtggataataaaggaagaaaaaggtacggtcaagcttctaagtatatctcagaccttgctgtcggttcagaattggtcgttagcgttaaaccatctgttatgaaattaccaccatctccaaagcaaccagttattatgagtggtttaggtactggtttggcaccattcaaggccattgttgaagagaaattatggcaaaagcagcaaggttatgagattggtgaagtcttcctatatctaggttcaagacacaaaagagaagaatatttatatggtgagttatgggaggcttacaaagatgcaggtattatcacacacatcggcgctgctttctcaagagaccaacctcaaaaaatttacattcaagatcgtatcaaagagaatttggatgaattaaaaactgcaatgattgataataaaggttcattttacttgtgtggccctacttggccagttccagatattactcaagctttgcaagacattctggctaaagacgccgaggaaagaggcatcaaagtcgacttggatgccgcaattgaagaattaaaggaagcatcaagatacattttagaagtctactaa

SEQ ID NO: 333 - DNA, 1923 bp, Saccharomyces cerevisiae
atgctatcgctaaaaaaatcagcgctctccaagttgactttgctcagaaacacaagaacatttacatcgtcagctttggtgcgccaaacgcagggctctgtaaacggttccgcgtccagatctgcagacgggaagtaccacataatagatcacgagtatgactgtgtggtaatcggtgccggtggtgccggccttagagcggcctttggtcttgccgaggcgggctacaagactgcttgtatatccaagcttttccccaccagatcccacactgttgctgctcagggtggtatcaatgccgctctgggaaatatgcacaaggataactggaaatggcatatgtacgatactgtgaaaggatctgattggctaggtgaccaggactccatccattacatgaccagggaagcgcccaaatcgatcattgaactggaacactatggtgttcctttttcaagaactgaaaacggtaagatctaccaaagagcctttggtggtcagaccaaggagtacggtaagggtgctcaggcctatagaacatgcgctgtcgcagacaggacaggacatgctcttttacacacgctttatggccaagctttaagacatgacacacatttctttattgagtactttgccctcgatctgttgacccataatggcgaggtcgttggtgtcatcgcttataatcaggaagacggtaccatccacagattcagagcacacaagaccattattgccactggtggctatggtagagcatacttctcttgtacctctgctcacacatgtacgggtgacggtaatgccatggtttcgcgtgctggtttccccttgcaagatttagagtttgttcaattccatccttcaggtatatatgggtctggttgcttaatcactgaaggtgctcgtggtgaaggtggttttttggttaattctgaaggtgaaagattcatggaacgttacgctcctacggccaaggatctagcttgtagagatgtcgtttccagagcaatcaccatggagatcagagaaggcagaggtgttggtaagaaaaaggaccacatgtacttacaattgagccatctacctccggaagttctaaaggaaagattgccaggtatctctgaaacagcagccatttttgctggtgtagacgtcaccaaggaacctattcccattattcctaccgtccactataacatgggtggtattcccacgaagtggaatggtgaggcattaaccattgatgaagaaactggcgaagacaaggttattcccggtttaatggcttgtggtgaagccgcttgtgtttctgtccatggtgccaatagattaggtgccaattccttgttggatcttgttgtctttggtcgtgctgttgcccatacggttgctgacactttacagcctgggttgccacacaaaccactaccttctgatttgggtaaagaatccatcgcaaacttggataaactaagaaatgctaatggttcaagatctacggcagaaattagaatgaatatgaaacaaactatgcaaaaggatgtttccgtctttagaacacaatcatctttagatgaaggtgttcggaacattactgcagtagagaagacctttgatgatgtgaagacgaccgatagatcaatgatctggaattctgacttggttgaaactctggagctacagaacttattaacctgtgcctcccaaacagctgtttccgctgctaatagaaaggaatcccgtggtgctcatgcaagagaggattatccaaatagagatgacgaacattggatgaagcatacattatcctggcaaaaggacgtcgctgccccagtgactttgaaatacagaagggttatcgatcacactttggacgaaaaggaatgtccttccgtacctccaactgtaagagcctactaa

SEQ ID NO: 334 - DNA, 447 bp, Saccharomyces cerevisiae
atgttcagcctacaagacgtaataactacaaccaagaccaccttggcagcaatgccaaaaggttacttaccaaaatggttacttttcatttccattgtatcagtcttcaattctatccagacttacgtttctggtttagaattgacacgtaaagtctacgaaagaaaacccactgaaacaacccatttgagtgcaagaactttcggtacttggacctttatttcctgtgttatcagattctatggggctatgtacttgaatgaaccacacattttcgaattggtcttcatgtcttatatggttgccctattccacttcggctctgaattattgatctttagaacttgtaagttgggaaagggattcatgggtccattggttgtctcaaccacctctttggtttggatgtacaaacaaagagaatactacactggtgttgcttggtaa

SEQ ID NO: 335 - DNA, 2667 bp, Saccharomyces cerevisiae
atgtcaggagaagaagaagtagattatacaacgttacccctagaagagcgattaacgtacaagttatggaaggcacgtttagaagcttataaggagttaaaccagctttttagaaactccgttggcgacatcagtagggatgacaacatacaaatttactggagggatcctacattatttgcacaatatataactgattctaatgtggtcgctcaagaacaagccattgttgccttgaatagtttaatagatgcctttgcgtcatcgtctttgaaaaatgcacataatattactttaatatcaacatggacaccattgcttgtggaaaagggcttaacgtcctcaagggctacaacgaagacgcagtcgatgagctgtatactctcactatgtggtcttgatacatctattacgcaatcggtggaattggtaataccctttttcgagaaaaaactgccaaaattaattgctgcggcagccaattgtgtttatgagttgatggctgcattcgggctcactaatgtgaacgttcaaacgtttctaccagaattattaaagcacgtacctcaactagccggtcatggtgatagaaacgttcgatcacaaacgatgaatttgattgtcgagatctataaggttacgggcaacaatagcgacttgttagaggagatactgtttaaaaaattaaaaccaattcaagtgaaagatcttcataaattgtttgcaaaagttggtgacgagccatcgtcatcgaaaatgttattcgagtgggagaaaagagaattggaaaagaaaagaagccaagaggaggaagccaggaaaagaaagtccatattatcgaatgatgagggggaatatcagatagataaggatggagatacattgatggggatggaaacggatatgccaccatcaaaacagcaaagtggagttcaaatagacaccttcagtatgctaccggaggagacgatcctcgataaactgcctaaggacttccaggaaaggataacgtcgtccaaatggaaagatagagtggaagcgctggaagaattttgggatagtgttctatcgcagactaagaagttaaaaagcacctcgcaaaattattccaacttattggggatatatggccatattatccagaaagatgcaaacattcaagctgttgcactagccgctcaatcagtagaattaatctgcgacaaactaaaaacaccaggcttttccaaggattatgtttcactagtcttcactcccttgttagacaggacaaaggaaaagaaaccttctgtgatagaggccattaggaaggcattattaaccatctgcaagtattacgatccattagcctccagtggacgcaatgaagatatgttgaaagatattttggagcatatgaagcacaagacacctcaaatcagaatggagtgtacgcaattgtttaatgcaagcatgaaagaagaaaaagatggatactcgaccctgcaaagatacttgaaggatgaagtggtaccaattgtgattcagatcgtcaacgacacccaacctgctataagaactattggatttgagagtttcgccattctaattaaaatatttggcatgaatacctttgtgaaaacattagagcacttggataatttgaaaaggaaaaaaattgaagaaacggtcaaaactctacctaatttcagtattgcaagtggtagtacccatagcactattgaaacgaataaacaaactgggccaatggagaataaatttctcctgaaaaaaagttctgtacttccctccaagagagtggcatcttcaccgctgagaaatgataacaaaagtaaagtgaacccaatagggtcagtagcctccgcatcaaaaccatcaatggtagctgctaacaataaatcgagggtcctgttgacgtctaagtctttggcaacgccaaaaaacgtagtagctaatagcactgacaagaatgaaaagttgattgaagaatacaagtacagactgcaaaaactacaaaatgatgagatgatatggaccaaagaaagacaaagcctattggaaaagatgaataatacagaaaattataagatcgaaatgattaaagaaaacgaaatgctaagagagcaactaaaggaagcgcagtctaaattgaacgaaaagaacattcaattaagatccaaggagattgatgtcaataagctgtctgatagagtactgtcactagaaaacgagcttagaaacatggagatcgaattggatagaaataagaaaagaaatgatacaaacttgcaatcgatgggtacgatttcatcatactccataccttcttccaccgtgtcaagcaactatggggtaaaatctttatcttccgctttgccatttaaggaggaggaagatgtcagaaggaaagaggacgtcaactatgaaagaagatcaagcgagtccatcggcgacctgccgcaccgcgtaaactctcttaacatacggccgtacagaaaaaacggcactggagtgagcagtgtctccgacgatttggatatcgatttcaacgatagttttgcctcagaagaaagttataaacgtgccgctgcagtgacatctaccctaaaggccagaattgaaaaaatgaaggccaaatcaaggcgggaagggacaaccaggacgtaa

SEQ ID NO: 336 - DNA, 3591 bp, Saccharomyces cerevisiae
atgcctccaaagaagtttaaggatctaaactctttccttgacgaccaaccaaaggacccaaatctagtcgcttctcccttcggtggttattttaaaaaccctgctgctgatgccggtagtaataacgcttccaaaaaaagtagctaccaacaacagcgtaattggaaacaggggggcaactaccaacaaggtggttaccaatcgtataacagtaattacaacaattacaacaactacaacaactacaacaattataacaactacaataactataataaatacaatggccagggctatcaaaaatctacttacaaacaatcggctgtgacgcccaaccaaagtggaactccaactccatctgcttctactacatctttgacctctttgaatgaaaagctgtcgaacttagagttaacacccatctctcaatttttgtcaaagatacctgaatgtcaaagtatcactgattgcaaaaatcaaatcaaactaatcattgaagaatttggcaaagaaggtaacagtacgggtgagaaaattgaagagtggaaaatcgtcgatgttctatctaaattcatcaaacctaagaatccatcattagttagagaatctgccatgctaataatttccaacattgctcaatttttcagtggaaagccaccacaggaagcatacttgctaccattcttcaatgtcgcacttgactgtatttcagataaagagaatacagtcaaacgtgccgcgcaacatgccattgattctttgttgaattgctttccaatggaggctttaacctgttttgtactgcctacgattttggattacttatcatctggtgccaaatggcaagctaaaatggccgctctaagcgttgtagatagaataagagaagattcggcgaacgatttattggaacttactttcaaagatgcagttccagttttaaccgatgtagcaactgatttcaaacctgaattggccaaacaaggttacaaaactttattggactacgtttctattttggataacttagatttgtctcctcgttataaattgatcgtggacaccctgcaagatccatctaaggttcctgaatctgtaaaatcgttatccagtgttacatttgtcgctgaagttacggaaccttcactatctttgttagttcctattctaaacagatctttaaacctatcgtcatcatctcaagagcaattaagacaaaccgttattgtcgtggagaatttgacaagattggtgaataatcgtaatgaaattgaaagcttcatccctctactactacccggtatccaaaaggttgttgatactgcgtccttacctgaagttcgtgaattggctgaaaaggcccttaacgttctaaaagaagatgacgaagctgataaggaaaacaaattctcaggcagactgactttagaagaaggtagggatttcttacttgatcacctcaaggacattaaagctgatgattcctgttttgtcaagccttacatgaatgacgaaactgttatcaagtatatgagcaagattttgaccgtggattctaatgtgaacgactggaaaagacttgaagattttttgaccgccgtttttggtggttcagattcacaaagagaatttgtcaaacaagactttatccataacttgagagctttattctaccaagaaaaggaaagggcagatgaggacgaaggtattgagattgtcaacactgatttctccttagcttatggttcaagaatgcttttgaacaaaacaaatcttcgtctcctaaagggtcatcgttacggtttgtgtggtagaaatggtgctggtaagtctactttaatgagagcaattgctaatggtcaattggatggttttcctgacaaggatacattacgcacctgtttcgtcgaacataaattgcaaggtgaagaaggtgatttagacttggtttccttcattgctttagatgaagaactgcaatctacttctcgtgaggaaattgcagccgctttagaatctgtcggttttgatgaagagagaagagcacaaactgttggatctttatctggtggttggaaaatgaagttggaattggcaagagctatgttacaaaaagctgatattttattgctggatgaacctaccaatcatttagatgtttcgaacgttaaatggttagaagaatacttactggaacatactgatattacttcattgattgtttcgcatgactctggtttcttagatacagtctgtactgacatcatccattatgaaaacaagaaattggcttactacaaaggtaacttggcagcatttgttgagcagaaacctgaagctaaatcttactataccttaacagattctaatgctcaaatgcgtttcccacccccaggtattttaacaggtgttaagtctaacactagagccgtcgctaaaatgactgatgtaactttctcttatccaggtgcccaaaagccttccttaagccatgtctcctgttcattgtctctgtcttctcgtgtggcttgtttaggtcctaacggtgctggtaaatccactttgatcaagctattaactggtgaattggttccaaatgaaggtaaagtggaaaaacatccaaatttacgtattggttatattgctcagcatgcattgcaacacgtcaatgaacataaggaaaagacggcaaaccaatatttgcaatggcgttatcaattcggtgacgaccgtgaagtcttattgaaggaatccagaaaaatatccgaagatgaaaaggaaatgatgacaaaggaaatcgacattgatgacggtagaggtaagagagccattgaagctattgtaggtagacaaaagttgaaaaaatctttccaatatgaggtcaaatggaaatactggaaaccaaaatacaactcctgggttccaaaagatgttttggtcgagcatggctttgaaaaattggttcaaaaattcgacgatcacgaagcctccagagaagggttgggttaccgtgaattaattccttcagttatcaccaaacattttgaagacgttggtcttgattctgaaattgctaaccatactccattaggttctttatctggtggtcaattagttaaagtcgttattgccggtgctatgtggaacaaccctcatttacttgttttggatgaacctaccaactatttggacagagactctcttggtgctttggccgttgctattcgtgactggagtggtggtgtcgttatgatttcgcataataacgaatttgttggtgctttatgtcctgaacaatggattgtggagaacggtaaaatggttcaaaagggctctgcacaagttgaccaatccaaattcgaagatggtggtaatgctgatgccgttggtctaaaggcctccaacttggccaagccatctgtagatgacgatgattctccagctaacatcaaggtcaagcaaagaaagaagagattgacaagaaatgaaaagaagctgcaagccgaacgtcgtcgtctacgttacattgagtggttgtcatcgccaaaaggtacaccaaaaccagttgatactgacgatgaagaagattga

SEQ ID NO: 337 - DNA, 1914 bp, Saccharomyces cerevisiae
atgacaacatatttcaagttggtaaaaggtgctaccaagatcaagtcagccccgcccaaacagaagtatctggatccgatactgttggggaccagcaatgaagaggatttctatgagatcgtgaagggtttggattcccgaattaatgacacggcgtggactattgtgtataaatcgctgttggtggttcatttgatgataagggagggttccaaagatgttgcattgcggtactactctaggaacctggagttttttgacattgaaaacatacgtggctccaatggcagtgcgtctggagacatgagggcacttgatagatacgataattatctgaaggtgagatgcagggagtttggtaaaatcaaaaaggactatgtgagagacggctatcgaacactgaagctgaacagtggcaattacggaagctccagaaacaagcaacactctatcaatatagcactagatcatgtggagtccctagaggtacaaatacaagccctgattaaaaacaagtatacacaatatgatttgagtaacgaattgatcatatttggtttcaagctgcttattcaagacctgctagcgctatataatgctctcaacgaaggtatcataactctgctggagtcttttttcgaactatctcatcataatgcagagagaactctagacctgtacaagacgtttgttgatttgaccgagcacgttgtcaggtacttgaagagcgggaagactgcgggcttgaaaatacccgtcatcaagcatatcactaccaaactggtcagatcgctagaagaacatctgatagaggatgataagacgcacaacacttttgtgcccgttgacagttctcaaggaagtgctggggccgtagtagccaaatctactgcacaggaaaggttggagcaaatccgggaacaaaaaaggatactagaggcacaattgaaaaacgaacaagtagcgatttcccctgctctaactactgtcacggcggctcaatcttacaacccgtttggaacagactcttctatgcatactaacattccaatggctgtggctaatcaaacgcaacagatcgcaaataacccatttgtatctcaaactcagccacaggtgatgaatacaccaaccgctcatacagagcccgcaaatttaaacgttcctgaatatgcagcggtccaacacacagtgaacttcaaccctgtacaagatgctggcgtaagtgcccaacaaacggggtactattcgattaacaaccatttaacacccacatttacaggtgcagggtttggaggatactccgtttcacaggatacaactgccgcttctaatcaacaagtctctcattcacaaactggttctaacaacccgttcgcattgcacaacgccgcgacgatcgcaacagggaatcctgcacacgaaaatgtcttaaataacccattttcacgaccaaactttgatgaacaaaataccaatatgccgctacaacaacagataataagtaacccttttcaaaaccaaacgtacaatcaacaacaatttcaacaacaaaaaatgcctttgagctcgatcaatagcgttatgacaacccctactagcatgcagggatcgatgaatattcctcagcgttttgataaaatggaatttcaggctcactacactcagaatcatctccaacaacagcaacaacagcaacagcaacaacagcaacagcaacaacagcaaccacaacagggttattatgtgcctgcaactgcaggagccaaccctgttacaaatataactgggacagttcaacctcaaaatttccctttctatccacaacagcaaccacaaccggaacagtctcaaacacagcaaccagttttaggaaaccaatatgctaacaacctcaatttaattgatatgtaa

SEQ ID NO: 338 - DNA, 3357 bp, Saccharomyces cerevisiae
atgacatcgatttatacatcaacagagcctacgaattctgcttttactaccgaggactacaaacctcaattagttgaaggagtaaattctgtacttgtcattggatcaggagggctctctattggtcaagctggtgaattcgattacagtggttctcaagctatcaaagctctgaaggaagataacaagtttactatattggttaacccaaatatcgctactaaccagacttctcattccctggcggacaagatttattacttgcccgttacaccagaatacatcacatatatcattgaacttgaaaggccggatgctatacttttaaccttcggtggtcaaacaggtctaaattgtggggtggctctggatgaatctggtgttttggctaaatacaacgtcaaagttttaggtactcctatcaaaactttgatcacttctgaagatagggatcttttcgcatctgcgttaaaggatatcaacattcccatcgcagaatcatttgcttgtgaaaccgtggatgaagctttggaggctgctgaaagggtcaaatacccagttattgtcagatctgcatacgctttgggtgggttaggctcaggtttcgctaacaatgcaagtgaaatgaaggaacttgccgcacagtccttgtcgttggccccacaaattcttgttgaaaaatctttgaaaggttggaaagaagttgaatatgaagtggtcagagatagggttggtaactgtattacagtatgtaatatggaaaatttcgacccacttggtgttcatactggtgattctatggtttttgctccttcgcagaccctatcagatgaagagtttcatatgttaagatccgccgcaattaaaatcattagacaccttggtgttattggtgaatgtaatgtccaatacgctttgcaacctgatgggctagactatagagttattgaagtgaacgcacgtttatctcgttcctctgcattggcgtctaaggccactggttatcccttagcatacactgccgccaaaattgggctaggctatactttgccagaattgccaaacccaatcacaaaaactacagtggctaactttgagccatctttggattatattgtggcaaaaatacctaagtgggatctttctaagttccaatacgtggacagatccattggttcctctatgaaatcagttggagaagttatggctattggtagaaactatgaagaagcctttcaaaaagcattaagacaggtggatccatcattattgggattccaaggttctactgaattcggcgatcaacttgatgaagccttgagaactccaactgatagaagagtccttgccattggtcaggccttaatccatgaaaactatactgttgagagagttaatgaattgagtaaaattgataaatggtttctttacaagtgcatgaacattgttaatatctataaagagcttgaatcagttaaatctttaagtgacttgagtaaagatctcttgcagagagccaagaaattagggttttcagataagcagattgcggttactataaataaacacgcctccacaaacattaacgaactggaaatcagaagtttaagaaaaacgttaggtataatcccttttgtcaagagaatcgatactttggccgcagaatttccagcacaaaccaattatttgtataccacttacaatgctacaaagaacgatgtggagttcaacgaaaatggtatgctggttttaggctctggtgtctatcgtattggttcatctgtagaatttgattggtgtgccgtgaacaccgcgaagacattaagagatcaaggcaagaaaactatcatgataaattataacccagaaacagtttccacagatttcgatgaagttgatagattatactttgaagaattatcgtatgaaagagtgatggacatttatgagttggagcaatctgagggttgcattatttctgtcggtggtcaattacctcaaaacattgccttgaaactttacgataacggctgtaatataatgggtaccaatccaaacgatattgatagagctgagaacagacacaaattctcatctattttggattctattgatgttgaccaacctgaatggagtgaattaacatcagtagaagaagcaaaattatttgcttctaaagttaactaccctgtgttgattcgtccctcatatgttctttccggtgcggcaatgagtgttgttaataatgaggaggaactgaaggctaaattaactttggcatctgacgtttctccagaccacccagtcgtcatgtctaaatttattgaaggtgctcaagaaattgatgtggacgccgttgcttataatggtaatgtcttggtacatgccatttccgagcatgttgaaaatgcgggtgtgcactccggtgatgcttctttagtcttaccgccacaacatctttctgacgatgtgaagattgccctaaaagacattgctgataaggtcgcaaaagcttggaagatcactggccccttcaatatgcaaatcatcaaggatggggagcatacattgaaagtgattgaatgtaacattagagcttctagatcatttccattcgtttcaaaagttttaggcgttaattttattgaaattgctgtcaaggcatttttgggcggtgacattgtaccaaaacctgttgatttgatgctcaacaaaaagtacgactatgttgctactaaagttcctcaattttcctttacaaggttggctggtgcagatcctttcttaggggttgaaatggcatcaactggtgaagttgcttcatttggtagagatttaattgaaagctattggactgctattcaaagtaccatgaacttccatgtaccactacctccaagtggtatattatttggaggtgatacatctcgagaatacttgggccaagtggcttccatagtggccactattggttacagaatatacacaactaatgagaccactaaaacgtatctacaggaacacatcaaagaaaagaacgcaaaggtttctttgattaaatttccaaagaatgataagagaaaattgcgtgaactatttcaagaatatgacataaaagctgttttcaatttagcctccaagagagctgagagcactgacgatgttgactatattatgagaaggaatgctattgattttgctatcccattgttcaatgaacctcaaacggctttgttatttgcaaagtgtttgaaggcaaaaattgcagaaaagatcaaaattttggaatctcatgacgttatagttccaccagaagtccgttcctgggatgaatttattggtttcaaagcatattga

SEQ ID NO: 339 - DNA, 2346 bp, Saccharomyces cerevisiae
atgaatattgcagaagaaccatcagatgaagtaatatctagtggccccgaggatacagatatctgcagccagcagacatcagcgagcgcagaagctggagaccaatcaataaaaattgaaaggaaaacttccactggtcttcaactggaacaattggccaacacaaatttattaaccataagaataaaatggcagttacaagaagaagaagatgatcactgcaactctagaataaccgatcaaataatggacacaatacagcactacaaaggtatctccgttaacaactctgatacagaaacatatgaatttcttccggatacaaggaggttacaggttctcgaacaaaataaagacatctatctttacgagcatggaagtcaagagtatgagaaatcttacaaagataacgaagaggaagatgattggagatacgataccgttttgcaagcacaattcaagtaccccaagtcattagaaaatgcatgtacagatatctcggaattactcaagagcgaacctattggtcagcatattgataaatggtctatcggtgtgaacaagcatgcactaacctatcctggaaatatttttgtcgggggaatagcaaagagcctttctattggtgaactaagtttcttattttcaaaatatggaccaattttatcaatgaaattgatatatgataaaacgaaaggcgaacctaacggatacgggttcatctcctaccccttgggttctcaagcttcactttgcatcaaggaacttaatggaaggacggtaaatggctccacactatttatcaactatcacgttgagcgaaaggagagagaaagaatccattgggaccatgtcaaagaaaacaacaatgatgataatttcaggtgtctctttataggcaacttgccttatcacaatcctgaaaaagtagagactttgattacacctaaagaagtcatagaagtaatcaagaaggagttatcaaaaaagtttccggactttgatatcatttcatattactttccgaagagaagtaatacaagaagcagtagttcagtaagtttcaatgaggaggggtcagtagaatcaaacaaatcttccaataatactaatggaaatgcccaagatgaagatatgttgaagggttatggtttcatcaagcttatcaaccatgaacaagcactagcagccatcgagaccttcaatgggttcatgtggcatggaaacaggctcgttgttaataaggcggttcaacataaagtttacaacaaccacaatagccatgacaggcacccttccatcagtaaccacaatgatatggaggttttggaatttgcaaataacccaatgtatgattacaataattatacatatgatagatattacttcaacaataataaaaacgggaacagcaacgatacctccaatgtacggtattttgattctgtaagatcaacccctgtggcagagaaaatggatctgttctatcctcaaagggaatctttcagtgaaggtcgtggtcaacgtgtgcctagattcatgggcaacaagtttgacatgtaccagtacccatcaacttcttacagcttacctataccaatgagtaatcagcaagaatcaaacctatatgtcaagcacatccctctttcttggacagatgaagatttatatgatttctacaaatctttcggtgaaataatcagcgttaaggtcattactgttgggggtagtaagaacaagtatcgtcaacaatcgaatgatagctcatcagataatgatctgccagtgggatcatcaagaggttatggttttgtttcttttgaaagcccattagatgctgctaaggcaattttgaatacagacgggtatcaagtgagcaaagatcaagtgttatctgtttctttcgctcagaaacgtggtaatttatcttcaagtgatgatgatgatcaatcccaaactgataactcatcaaagttccaaaattttcagccacataatgattatcataaggcttatccaacaaagtataataagaaatttatcaatgccttgatgactcagaaccaatcgcaacagcaagtctcgagggaaaattatttcataccactgcagtaccctaataccaacacaaagcccgtgaacagttacaacttaataagtgcaaaccaaaataacgctaactggatgatgccaatgttcccatcatttgggtttattccacaggtgccgccagtgccctatataatacctccgcagaatcctgcagcaaatcatattcctataatggcaaacggtagtaatgaagaggaagaattttctagtggtgattattctatggactactag

SEQ ID NO: 340 - DNA, 2193 bp, Saccharomyces cerevisiae
atgaccattgatggcacggggcaatctaaggaggcgctgcaagatgaacggttaaatactggctctgataaggtttaccaaaactatatgatgcctgctttagaactctacgatgccaaggtctccataaaccattggcagttgcgggattgtatcaaaccaggctccatgaaccagagtaaactgtattatatttacgatcattcgataagagtactagatacggattcttccgtattgaggtctccagtaaggcgacataattctattcaaccgagtaacagtggtaaaaactctactgaaaaaacgtctacaaaaggttctaggacaacgggctcgtatatctccaaaaatttacatgttccttccgagaaactggtagagttcaactttaagccgagatgtttcacggaattaaatgggttgactgtttgtggtggtctaatcggttctgatgataagggattcccttctaattggaaccgtttagctcaagatgcaaatatttcgttgccgccaccttcccaaccgattaatatttccaaaaatattagtttccctataaattcacattattcaaatcctaatatctggaagggcatcgtggagttttataatcaagaaacggacacaatgatgacttttacgttgggccagttcatcaataattgtgtcacactttatgacagggccagtatgcagtttgatctttttgcatgcaacaatgatggtcatctttaccaatgcgatgtaagtaatagagatgtaacactagtgaagcgttatgcggatttaaaatttcctttgaataacgcttctttgtcacatgatggtcaaacgatggtagtgtctggcgattctaataaatttgctgtttacaatcaaaatgaattaaccaaccaattctccttacattacgataatcatccttcctggggtagttctgtcaatcgtgttagacggataccacggtttgcgttacctgatgaatcagaatatatcgaaaacatatatgaagctccaaattcagaccatgggttttataactctttttccgaaaacgacttgcaatttgcgacggtatttcaaaatggtacttgcgcaatttatgatatcagaaacatggctactcccatggcagaaattagttcgactagaccacattcccacaacggtgcatttagagtctgtaggttcagttatggcctagatgatttattattcatttctgaacatcagggcagagtacacgttgtagatacaagaaactacgttaaccaccaagttattgttattcctgataaagttaatatggaatatataaacgaacggaagcataatacaaatcataatttcaccacaaataataacaacgaaaacgaaagtaatgatagcaaaaatgaattacaaggggcggattatcggtctttatcaagaagaagattttcgctgccctctatgccaaatgtaaccacagaaccatggataactatggctcaaagaatcccaaaaaagtatttggagccgcaaattctaccttttccgaaagttatggataaaattagtaacgaatcggttctgttttctacgaaaggtagttcatcaagtgacgtagctcatccatacaagagacgatgttcattcagggtaaggagagtatcgacttcggcaccaaccgccgattattctaataacaatgttaacgcaagtcttggcacacctgctgctgattctatcgcaacttcgtcgtcaaattccgcacctcaaaatttaattgaccccttaatactttctcaccagcaagctagtaatgatgtttttgaagatgatgaatattatgaagcttacaatgatgttcactcaacgtatcgtgtttcttcagactatcatggtgtttccgcaagagcttttgaaagttttctcagaccaccttcaacgccagacttaccgtcagatgatgacaattttgctgcaaatagtaggaataatagaggcacatccaattttttgagaagaccagtgattacaactcaggaaagtaacgaattctcagaagaaaacaatatatcaggtatcgattgggttgaagataggaatgggagctccttgattattggtacagattacggaattatgaggtggaatattaactcatgggcaagaagaagtttctctagttatgacttatgttga

SEQ ID NO: 341 - DNA, 2139 bp, Saccharomyces cerevisiae
atgcgattgttgctgtgcaagaattggtttgcgtcacctgtaatctcaccactactgtatacccgctccttatattcaatggctaacactactagtttccctattgctccccaggccccgcctaattggtcgttcactcccagcgatattagtgggaaaaccaacgaaatcatcaacaacagcaacaatttctatgattctatgagtaaggtagagagcccttccgtgagtaattttgtggagcctttcatgaagtttgaaaatgaattgggcccaataattaaccaattaactttcttacagcatgtgtcgtctgataaagaaattagggacgcatctgtgaactcctcaatgaaactggatgagttgaacatcgatctatctctgcgtcacgacatctttttgcaattcgcccgcgtctggcaggatgttcaatcgaaggcagattctgtggaaagagaaactttcaaatacgttgagaagtcttacaaggactacattcattctggtttggaacttgacgagggaaaccgattgaaaatcaaagagatcaaaaagaagatctccgttaactctattaatttttcgaagaatctgggagaacaaaaggaatacatcactttcaccaaagaacaattggaaggtgtgccggattctattttgacgcagttcgagacaataaaatctgacaaagatagcaatgaaaccttgtataaagtcaccttcaaatatccggacatttttcccgtgatgaaattggcatcctcagctcagactagaaagcaggcctttttggccgaccaaaataaggtccctgaaaatgaagctatactgttggatacattgaagctgcgtgacgaattggcctcgttattgggctatgacacgtatgcgaactacaacctgtatgataaaatggctgaagatagcactacggtaatgaactttttgaatgatttgaaggacaagctaattccgctgggcagaaaggaactacaggtcttgcaagatatgaaagccgaagatgttaagaaacttaaccagggtgcagatccaaactactacatttgggaccaccgttactacgataacaaatatttgttagaaaacttcaatgtggacctagaaaagatttctgaatattttccactagaggctacgattactggtatgctggaaatatacgaaacattgtttaatttgaagtttatcgagacgaaagattctcaaaacaaatctgtttggcatgacgacgtcaaacaaatcgccgtttggaatatggatgatccaaagtctccaaactttgttggttggatttatttcgatttacatcctcgtgatggtaaatatggccacgctgccaattttggtttatcgtcatcattcatgattgatgacaccacaagatcgtatccggttactgcgttggtttgcaatttctccaaatctacgaaggataaaccttctctactgaagcataacgaaatagtgacctttttccatgaattgggccatggtatccatgacctggtgggacaaaacaaggaatcgaggtttaatggccccggatctgttccatgggattttgtggaggcaccttcccaaatgttagaattttggacttggaataagaatgaattaatcaacctctcatcacattacaaaacgggcgaaaaaattccagaatctttgatcaattcattgatcaaaactaaacacgtaaatggtgctttattcactctaagacaattacattttgggttatttgatatgaaagtacatacttgtaaagacttgcaaaacctgtcaatttgcgatacctggaaccaattgagacaggatatttctttgatttctaatggtggtacgttatccaagggttatgattcatttggccatataatgtcagactcttactctgccggttattacggttatctatgggcggaagtctttgcaactgatatgtatcacaccaaattcgctaaggatccgttaaatgccaagaatgggatacaataccgtgatattgtgttggctcgtggtggcctttatgatattaatgataatctgaaagaatttttgggtagggaaccttctaaggatgctttcttgaaggagctgggcttacagaactaa

SEQ ID NO: 342 - DNA, 2295 bp, Saccharomyces cerevisiae
atggatgaacacgaggaagcagtcatcttcggtatctgccttgtggactttcatcacaaaagaggccctgaaatagaatactggtatggcttacctgagggcacccaaagtgcagaactatggccaaatttacccttccaggcccttcctgatggttctcactcgtttgaagaaacatttacttatttcacattactatatgatgaaagaagacaaaggagccctcccaacggggcaactgatctgagtgatgatagcatcaatgacaacacgactttgtttgccatatcttgctcgagacagataaagagtgatgaattggtcactaaagataaggatgtaacacgatctactgtacagaaggcaattgtagtcatctcaaggcaaccaatcttcggtcaaatcaaggacaaacttagtattgtgactaatgcttttttcttgcagcatgattttggggacaggaagataatccagtctttatacgaaaacctgaagtcgatttacacgcctgcatcattggtcagaaatgccgaaaatcgtctttatattgggttatgtctgagaaagatactacatgattttaagagaaacgctttagtcttattgaaagcaattatgcttgaaaaaaaaattatagtttacggcaacgacgtggaagctttgtgtaatttacagttcggtctgatcagcttaattccggacttgatgtcaaatttgcaggattctggcagtcctcagttgtttcaggatatttcgaaattaaatgttgtggactcgtttaaatcaagcaatcgagaatcagtgttgagattcttaggttttccattaccgattttcgaaaaaggtggactattttcaccctatactccactgcagcaaatgaatgacatacggtcagaacgtactttgttttttatgattggaagttccaacacattgcttgctgaacaaaaggaggaactgtgccacatatttgtcaatacagacaattccactgtagatattctggacaagactttgaaccccgtcctccaattgtcaagtcatgataaaaaatggattgaatctatatctggaattgtatcagacacatggaacgaaaatgatgatgaaactccaaaaaactctcaatttgaaggcagtgaggatttcattaggtggcaattcgaggactatttaacggggttactttccagtgttaaattaagtgattatttggacctgcataaagagaatgatcaagctttgaagactatacctgaggatatgctaaattccaatcccgttcatttattcaatttgaattgggttcagagttggaaagagactcaaaattttctgatattcaactcaagaacagatgatagattgttcgacttgtttcctccgaagcatatatataacggtgccgacactctgtctctattacagcaacgatttttggccacatttcataatttaaaaagaagctctagcaactcttcaagcaataaaaatggtcatcaaagcgaggaggatatcaaagaccaggaaagcatcgagtcaaaaaagtctgtttcccaaatttctgtaaatcctggaaagaatacagacaagccagcagccaacttatggaattcatggaaggaatatttcaataaaccaaagaatactgctaatgaagatgttactgaatccacagaagatctcaaaaacagaagtaaaacatcgaacgcgatacagaaagctatgatgggcttgggtttacattataaacctgatgcggagacagatcaacaaagtgaagaggtgggaaatagtgaggacaatgaagatgatgatactgatgaggactctgaggatgatgatgatgatggtggtgatgacgatgatagtgaggacgatgacgatgacgatgacggtgagggcgatgaaaatggcgatgacggtgagggcgatgaaaatggcgatgacggtgagggcgatgaaaatggcgataaggaagacagtcaagattttagcaatggttttacagacgttacgaacattaacactgatcatgataaagaaaatgaacagaattttgagggtaatgcagaaaattttaatgaggacgaaaccgttgcagataaagatattgaaggtggtcctgagagcaataaaaattccgacagtaaaactgatatttatgaaaacgatagaaatgttgaagactcatctaaaacgagaaatacagttaaaaaatccaatgaggagggcggtgcgaatgacgctgctataggtaattgtgtgcaggatgaggaaaaattatga

SEQ ID NO: 343 - DNA, 3165 bp, Saccharomyces cerevisiae
atgccgccgctattcaagggactgaaacagatggcaaagccaattgcctatgtttcaagattttcggcgaaacgaccaattcatataatacttttttctctaatcatatccgcattcgcttatctatccgtcattcagtattacttcaatggttggcaactagattcaaatagtgtttttgaaactgctccaaataaagactccaacactctatttcaagaatgttcccattactacagagattcctctctagatggttgggtatcaatcaccgcgcatgaagctagtgagttaccagccccacaccattactatctattaaacctgaacttcaatagtcctaatgaaactgactccattccagaactagctaacacggtttttgagaaagataatacaaaatatattctgcaagaagatctcagtgtttccaaagaaatttcttctactgatggaacgaaatggaggttaagaagtgacagaaaaagtcttttcgacgtaaagacgttagcatattctctctacgatgtattttcagaaaatgtaacccaagcagacccgtttgacgtccttattatggttactgcctacctaatgatgttctacaccatattcggcctcttcaatgacatgaggaagaccgggtcaaatttttggttgagcgcctctacagtggtcaattctgcatcatcacttttcttagcattgtatgtcacccaatgtattctaggcaaagaagtttccgcattaactctttttgaaggtttgcctttcattgtagttgttgttggtttcaagcacaaaatcaagattgcccagtatgccctggagaaatttgaaagagtcggtttatctaaaaggattactaccgatgaaatcgtttttgaatccgtgagcgaagagggtggtcgtttgattcaagaccatttgctttgtatttttgcctttatcggatgctctatgtatgctcaccaattgaagactttgacaaacttctgcatattatcagcatttatcctaatttttgaattgattttaactcctacattttattctgctatcttagcgcttagactggaaatgaatgttatccacagatctactattatcaagcaaacattagaagaagacggtgttgttccatctacagcaagaatcatttctaaagcagaaaagaaatccgtatcttctttcttaaatctcagtgtggttgtcattatcatgaaactctctgtcatactgttgtttgtcttcatcaacttttataactttggtgcaaattgggtcaatgatgccttcaattcattgtacttcgataaggaacgtgtttctctaccagattttattacctcgaatgcctctgaaaactttaaagagcaagctattgttagtgtcaccccattattatattacaaacccattaagtcctaccaacgcattgaggatatggttcttctattgcttcgtaatgtcagtgttgccattcgtgataggttcgtcagtaaattagttctttccgccttagtatgcagtgctgtcatcaatgtgtatttattgaatgctgctagaattcataccagttatactgcagaccaattggtgaaaactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 344 - DNA, 2343 bp, Saccharomyces cerevisiae
atggctcctaaatctagttcttccggttccaaaaagaaatcatcggcaagttctaatagtgctgatgcaaaagcatccaaatttaaattgcctgctgaatttattaccagaccacatccttctaaagatcatggcaaggaaacatgcacagcatatattcatcctaacgtattatcctcgcttgagataaatccgggatcattttgtactgtcggtaagataggcgaaaatggtattttagtaatagctagagcgggtgatgaagaagtacatcctgttaatgttatcaccctttccacaactatacgatctgttgggaaccttatccttggtgatcgtctagaattaaagaaagcccaggtgcaaccaccttatgccactaaggttaccgtggggtccttacaaggatataatattttggaatgtatggaggaaaaagtaattcaaaagctactggatgatagtggcgttataatgcctggaatgatttttcaaaacttaaaaacaaaagcaggtgatgaaagcattgatgtcgtaattacagatgcgagcgatgattcgcttcccgacgtcagccaactagatcttaacatggacgatatgtacggtggattagataacctgttttatctatctccaccttttatattcagaaaaggctccacacatataactttttcgaaagaaacccaggcaaatcgtaaatacaatcttccggagcccttatcctatgcagcagtgggcggcttagacaaggagattgaatcactgaaaagtgctattgaaatacctcttcatcaaccgacgctatttagtagctttggtgtttctccccctcgaggtatacttcttcacggacccccaggtactggtaaaactatgcttttgagagttgtagcaaatacgtccaacgcacacgtcctaaccattaatggcccctcaatcgtctccaaatatcttggtgaaacggaagcggcattaagagatatttttaatgaagcaaggaagtaccagccttccattattttcattgacgaaattgattcaatagcaccaaatagagcaaacgatgactccggtgaagttgagagcagagtcgtggctacattgcttaccctaatggatggcatgggcgctgcaggtaaagtggtggtaattgctgctacaaacaggcctaattctgtcgaccctgctctcaggagacctggcaggtttgaccaagaagtagaaattggtataccagacgttgatgccagatttgacattttaactaagcaattctcaagaatgtcctcggatcgtcacgtattagattctgaagcgatcaagtacattgcttctaaaacgcatggctatgttggtgctgatttaactgctctctgcagagaatcagttatgaagacgatacaacgaggactaggaacagacgccaatattgacaagttttccctaaaagttacattgaaagatgtggagagcgccatggttgatatcagacccagcgcaatgagagaaatcttcttagaaatgccaaaagtttattggtctgacattggcggccaagaagagcttaaaacaaagatgaaagaaatgatacagttgcctttggaggcttcggagacttttgccaggctgggaatttctgcaccaaaaggtgtattactttacgggccgccaggttgctccaagacattaaccgcaaaagctctcgctacagaatcgggtatcaacttcttagctgtgaaagggcctgaaatttttaacaagtatgtaggggaatccgaaagagctataagagaaattttccgcaaagcacgctctgcagctccaagtattatcttctttgatgaaatcgatgcattatctcctgatagagacgggagttccacctctgcagctaatcacgtgctcacatctttactcaatgagattgatggtgttgaagagttaaagggtgtagttattgtagcggcgacgaatagacctgatgaaatagatgctgctcttctaaggcctggtaggttagatagacacatttacgttggccctccagacgtaaacgcccgcttggaaatcttaaagaagtgcacaaagaaatttaatacagaagagtctggagtcgatcttcatgaattggcagaccgtacagaaggttattccggagctgaagttgtgctgctttgtcaagaagcgggcttggctgccataatggaagatttagatgtcgcaaaagtggaattacgtcattttgagaaagcttttaaaggaattgctaggggcattactccagaaatgctctcttattatgaagagtttgctctaagaagcggttcatcttcgtaa

SEQ ID NO: 345 - DNA, 1050 bp, Saccharomyces cerevisiae
atgagtgcttccaaaatggccatgtccaacctagagaaaatattggaactggttcctctttcgcctaccagttttgtcacaaagtatctgcctgccgcgcccgtagggtctaagggcacttttggtggaacgctggtatcacaatcgctgctggcgtcattgcatactgtgccattgaacttcttccccacatcgctacattcgtatttcatcaagggtggtgatccgcggaccaagatcacgtaccatgtgcagaatctgagaaacggtagaaatttcatccataagcaggttagtgcttatcagcacgacaagttgatatttacgtcgatgatcttatttgccgtgcaacggtccaaggagcacgactccttgcagcactgggagacgattccaggcctgcaaggtaagcagccagaccctcatcgttatgaagaggccacttcgcttttccagaaagaagttctggacccacagaaattgagcaggtatgcctcattgtccgacaggttccaagacgcaacctcgatgagcaagtatgtggatgcgtttcaatacggagtcatggagtaccaattccccaaggacatgttctactcggcaagacacaccgacgagctggattatttcgtcaaagtgagacctcccatcactaccgtggagcacgcgggcgacgagtcttctttacacaagcatcatccgtacaggatcccgaagagcattactcctgagaacgacgctcgctacaactacgtggcctttgcgtatctgtccgattcctacctcctactcacgatcccgtacttccacaacctgcctttgtactgccacagtttcagtgtctcgctcgaccacacgatttactttcaccagttgcctcatgtgaacaattggatctatcttaagatttcgaatcccaggtcccactgggacaagcacctcgtacagggcaagtatttcgacacacagtcgggacgcatcatggcaagcgtctctcaggagggctacgttgtctacgggtcagaacgagacattcgagccaagttctga

SEQ ID NO: 346 - DNA, 2523 bp, Saccharomyces cerevisiae
atgaaagtggtaaagtttccatggttggctcaccgtgaagaatcgcgaaaatatgaaatatacacagtcgatgttagccacgatgggaaaaggttggccacaggcggcctagatggcaagattaggatatggtccatagattccattttgcgttgcatggaactagaatctctaactcctgagatacctcttccgcaagacttgcagatgccgttatgtagcatgagtaggcataccggctcgataacatgtgtcaaattctcaccggatggaaagtaccttgcaagtggatccgatgatcgaattttactgatatgggctcttgacgaggagcaaagctcacaacccgcctttggttctgagcatgagagagagcattggacagttcgtaaaagattggttgcacacgataacgacatacaagacatttgctgggcgccagactccagcatactagtgacagttggtttagatagatctgtcatagtctggaacggttctacatttgaaaaactgaagagatttgacgtacatcaatcacttgttaagggcgttgtttttgatcccgctaataagtattttgcgactacatctgatgatagaaccatgaagatatttagatatcacaagacgggggatatttcttttacaatagagcatataatcaccgagccattcaaagaatcacccttgactacttattttagaaggccatcgtggtctcccgatgggcaacatattgcagttccgaacgccactaatgggcccgtaagttctatggcaattgtaaatagaggaacttgggatacaaatgttagtttaattggtcatgatgcacctacagaagtcgcaaggtttaatcctagattgtttgagagaaatgcgggtgtcaagcaaaaaaaagacgatgacccagaaaatgctctagtggggcaaaacgatgataaagttcaccattttgataaaaacatcgactctgttgtggcaacagctgggcaagataaatccttagcggtctggagtacaagtagaccaaggccaatattagttgctttcgatatcgcaaataaatcaattactgatatgtcttggaatccagacggctctttattatttgttgcgtcattagactcttcaatcaccttgtttaaattcgaaaataatgaactaggcaagccaattcctttggaaaaaaatatggagcagttatataggtacggtgttgacaaggactcattagatttccctgaaagtatcaaccaactgttactcgaagatcagacaaaatcatttaagcatacaaaaatttcaacatcgaaactaggtgaaaaccacccgacacttgcaacaaattcagcttcaaatcaaaaagataacaatgatgcttctgtctctagaagtgaacatataaatatcttgattccaaagaggaaaaaggatgctatactgaataaagccgtaactcttaaaagcggtaaaaagcgtgtggcaccgacattgatatcgacttcatcatcttctcccttttctaatggaatcaaaaagcctacattggatagtaaaaggattgaaaataatgtaaaatcatccaccaagaccattaacagtaaaaatacattgctaaatgtgccagaaggcgttgaaaagaaaattagtatctcatcgttcccattgccaaggttgggcatacattctttgattatgggtacaaaagaaaggagtgcatggaaaatctcaaattcagagctggagaatgatgatgcagataatgcgggtggtaagggttcagatggtacgagcaacagtattgacgacattgcagttctctcagaggaagaaaatgactttcataggatgactttgaacgccaagctaacccaggagaagatctggagcgaagagccgacaacacgatgccttctgcagtccgatgtcataccagacacagatgttgtcgttcttgaggggggtagtttagacgatatagccgttttagaaataagaaacggtgttgagagatcaatacaatttgattctgaagcacttttagataatcctaccagaatcttaggctatcaaggaggtaaaagaaccatcgagacctttattccagaagttatcatttgtgcaataggatcaaaagattgtaagtgctggtgcctagcttcagctaatggctctatttacatactttcatacaatggacagcagagaatcccaaaaatttgcctaggacataaagttattaaaatggtaacatcaagcaaatacctccttgttctaactgaaagaggtttattttttgcatgggacttgctggatttaaaattagtactgcgaaatgtacctatattaccaattttgaacggtcagccaattcatggaaacaaggtaagaatcaacaaggttattaaatgctttcgtttggatggttctagttgtgatttgcttttagaggttggcgatcctaaaaatgtgtataaatggactaaggatctgggttgttggtcgttatataaataa

SEQ ID NO: 347 - DNA, 3537 bp, Saccharomyces cerevisiae
atgtcgcaaagaaaattcgccggcttgagagataacttcaatctcttgggtgaaaagaacaaaatattggtggctaatagaggagaaattccaatcagaatttttcgtaccgctcatgaactgtctatgcagacggtagctatatattctcatgaagatcgtctttcaacgcacaaacaaaaggctgacgaagcatacgtcataggtgaagtaggccaatatacccccgtcggcgcttatttggccattgacgaaatcatttccattgcccaaaaacaccaggtagatttcatccatccaggttatgggttcttgtctgaaaattcggaatttgccgacaaagtagtgaaggccggtatcacttggattggccctccagctgaagttattgactccgtgggtgataaggtctcagctagaaacctggcagcaaaagctaatgtgcccaccgttcctggtacaccaggtcctatagaaactgtagaggaagcacttgacttcgtcaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggccgataaccacggaaacgtggttcatcttttcgaaagagactgttccgtgcagagaagacaccaaaaggttgtcgaagtggccccagcaaagactttaccccgtgaagtccgtgacgccattttgacagatgcagttaaattggccaaagagtgtggctacagaaatgcgggtactgctgaattcttggttgataaccaaaatagacactatttcattgaaattaatccaagaatccaagtggaacataccatcacagaagaaattaccggtatagatattgtggcggctcagatccaaattgcggcaggtgcctctctaccccagctgggcctattccaggacaaaattacgactcgtggctttgccattcagtgccgtattaccacggaagaccctgctaagaacttccaaccagataccggtagaatagaagtgtaccgttctgcaggtggtaatggtgttagactggatggtggtaacgcctatgcaggaacaataatctcacctcattacgactcaatgctggtcaaatgctcatgctccggttccacctacgaaatcgttcgtagaaaaatgattcgtgcattaatcgagttcagaattagaggtgtcaagaccaacattcccttcctattgactcttttgaccaatccagtatttattgagggtacatactggacgacttttattgacgacaccccacaactgttccaaatggtttcatcacaaaacagagcccaaaaacttttacattacctcgccgacgtggcagtcaatggttcatctatcaagggtcaaattggcttgccaaaattaaaatcaaatccaagtgtcccccatttgcacgatgctcagggcaatgtcatcaacgttacaaagtctgcaccaccatccggatggaggcaagtgctactagaaaaggggccagctgaatttgccagacaagttagacagttcaatggtactttattgatggacaccacctggagagacgctcatcaatctctacttgcaacaagagtcagaacccacgatttggctacaatcgctccaacaaccgcacatgcccttgcaggtcgtttcgccttagaatgttggggtggtgccacattcgatgttgcaatgagatttttgcatgaggatccatgggaacgtttgagaaaattaagatctctggtgcctaatattccattccaaatgttattgcgtggtgccaatggtgtggcttattcttcattgcctgacaatgctattgaccatttcgtcaagcaagccaaggataatggtgttgatatatttagagtctttgatgccttaaatgacttggaacaattgaaggtcggtgtagatgctgtgaagaaggcaggtggtgttgtagaagccactgtttgtttctctggggatatgcttcagccaggcaagaaatacaatttggattactacttggaaattgctgaaaaaattgtccaaatgggcactcatatcctgggtatcaaagatatggcaggtaccatgaagccagcagctgccaaactactgattggatctttgagggctaagtaccctgatctcccaatacatgttcacactcacgattctgcaggtactgctgttgcatcaatgactgcgtgtgctctggcgggcgccgatgtcgttgatgttgccatcaactcaatgtctggtttaacttcacaaccatcaatcaatgctctgttggcttcattagaaggtaatattgacactggtattaacgttgagcatgtccgtgaactagatgcatattgggcagagatgagattgttatactcttgtttcgaggctgacttgaagggcccagatccagaagtttatcaacatgaaatcccaggtggtcaattgacaaacttgttgtttcaagcccaacaattgggtcttggagaacaatgggccgaaacaaaaagagcttacagagaagccaattatttattgggtgatattgtcaaagttaccccaacttcgaaggtcgttggtgatctggcacaatttatggtctccaataaattaacttccgatgatgtgagacgcctggctaattctttggatttccctgactctgttatggatttcttcgaaggcttaatcggccaaccatatggtgggttcccagaaccatttagatcagacgttttaaggaacaagagaagaaagttgacttgtcgtccaggcctggaactagagccatttgatctcgaaaaaattagagaagacttgcagaatagatttggtgatgttgatgagtgcgacgttgcttcttataacatgtacccaagagtttatgaagacttccaaaagatgagagaaacgtatggtgatttatctgtattgccaacaagaagctttttgtctccactagagactgacgaagaaattgaagttgtaatcgaacaaggtaaaacgctaattatcaagctacaggctgtgggtgatttgaacaaaaagaccggtgaaagagaagtttactttgatttgaatggtgaaatgagaaaaattcgtgttgctgacagatcacaaaaagtggaaactgttactaaatccaaagcagacatgcatgatccattacacattggtgcaccaatggcaggtgtcattgttgaagttaaagttcataaaggatcactaataaagaagggccaacctgtagccgtattaagcgccatgaaaatggaaatgattatatcttctccatccgatggacaagttaaagaagtgtttgtctctgatggtgaaaatgtggactcttctgatttattagttctattagaagaccaagttcctgttgaaactaaggcatga

SEQ ID NO: 348 - DNA, 1020 bp, Saccharomyces cerevisiae
atggcgggaagtacatccagtttggtgatctgtgcgattggtatatatgctacttttttgacgtgggcattagtacaggagcctttggctacaagaacctggccaaactccatgggaaagtttcaattccctaatgtaatatccctcatacaagcttctgtggcaatgatgatgggctacctgtacttaaactggaagaaggtggaatatccgcccagaaaaatgattaaagatcattggaaacaattgatgttgatatcatttacacagagtagttcaggcccgctggctacaacttctttaaagcacgtggattatctcacttacatgttagcaaagtcatgcaagatgatccccgtgttgttggtgcatttgcttttgtataggacgcccatagcaagccaaaaaaaagttgtagctctcttggtaagtctcggtgtcactattttcactataggtggcaacgatggtaaaaagttgaagagatcctttaatgagagcggaaatgataacaaattacaagggtttggactacttttctctagtttattccttgatggattgaccaacgccacccaagataagctactaaaggccaataaggccaaagaaaagggaaaacaaactttgataacaggtgcacacttgatgtttacactgaacctcttcgtgatattgtggaatattttgtattttattgtgatcgactgcaaacaatgggataatgccgtttctgtattgacgatggacccacaagtgtggggctatttaatgctttattcgttctgtggcgctatgggacaatgctttattttctatactctagaacaatttggctctttagttttgatcatgataacagtcaccaggaaaatggtctcgatgattttgagtattattgtcttcggtaagagtgtacgtttccagcaatgggtggggatgtttatagtatttggtggaatcacttgggaagcactcaacaagaagaaggctaatataccgaaggcaaaatctgcgtag

SEQ ID NO: 349 - DNA, 1050 bp, Saccharomyces cerevisiae
atgtcaaagatagattcagttttaattatcggtggttctggttttcttggattgcacttaattcagcaattttttgatattaatcctaagccagacatccacatttttgatgttagagatctccctgaaaaactttcaaaacagtttacttttaatgtagacgacataaaatttcataagggtgatttaacatcacctgatgatatggaaaacgcaattaacgaaagtaaagcaaatgttgttgttcattgtgcttctccaatgcatggtcaaaatccagatatttatgacatagtgaatgttaagggaacccgtaacgtgatagatatgtgcaagaaatgtggcgttaatatacttgtatatacttcctctgctggtgttatttttaatgggcaagatgtgcacaatgcagacgaaacctggccaatcccagaagttcctatggatgcgtacaatgagactaaagctatcgccgaagatatggtcttgaaggcgaatgatccaagcagtgatttctatactgttgctcttcgtccagctggtatttttggcccaggtgataggcaattagtacctggtctaagacaggttgcgaaattggggcagtcgaagttccaaattggtgataataacaatctatttgattggacttatgctggaaatgttgctgacgcgcatgtgttagctgcacagaaacttctcgatccaaaaacaagaactgctgtctcgggtgaaacttttttcattaccaatgatacccccacctatttttgggccttggcccgtactgtgtggaaggcagatggtcatattgataaacatgttattgttttgaaaaggccagttgcaatttgtgcaggttatctttcagaatgggtatccaagatgctgggtaaagagccaggtttgactccattcagagtcaagattgtgtgtgcataccgttatcacaacattgctaaggccaaaaagttgctaggctacacaccaagagttggtattgaagaaggaattaacaaaacgttggcctggatggacgaaggtttgtaa

SEQ ID NO: 350 - DNA, 2553 bp, Saccharomyces cerevisiae
atgttgctagtacgaacgacttccctgaatgtgtcaaggatgccagtgccatgcctcgccagaggaataggcatcctcaagggcaaatatagactagcgaacctgatgaatgcccaaccctcagtgagacatgtgtcgagcgagatccagcaaaaggatcagcaggcaggagagtcaaacaccgccaccgatactggtgttattcacaaatcagatgaagaaactctgatatatttcgataatgtttacgctagaaccacctcggtttggaatccaacactgtggtacaatctcctgctaagaaaccagtcacgggatgcagtgagggagaaaataaggaatttagccagtccacccaataaccccatttatggactggagttgaagtctaccattccagtgaaaagggatggtggtgtatttgccacatttgtcgttccacccaagtatacaaaagctcaggtaaattctctaatccaacagaatacagccagagaatcctctaaaaacttactctcgtacttcactcgagcttctgccttcccagtaaagggttcgccttggattgaggatttaagaagactaccaagtaccactatagtcatcaagttccaagggcccgccttaacagaagaagaaatatactctttattcagaagatatgggacaattattgatattttccctcccactgctgctaacaacaatgtggcaaaggtaagataccgttcattccgtggtgccatttctgccaagaattgtgtttccggtatcgaaattcataataccgtcttacacatacaatacgaaaatatcagaagaggccatctagttagtaattttttcaccaaccatacaaggattgctattccagttttatttgcgctactttcaatctttgctgttttagtgtttgatcctataagagaattttcgattgaacagaagatcactcacaaatattctttatcgtgggacaataagttttggaaacaactgaaaacgctaacctcatctaccatgacttctatcaagtactactggggcggccctgatgataatcaccaaagaaagcatttatgggaggaaagaatagagaaagtgaatgacctgaaaatgtggcttgaagaaaataataatacttttgtggttataagggggcctagaggttcagggaaacatgatttggtcatgcaacacactttgcaaaatagagcaaatgttttgtatttggattgtgataaattgattaagtccagaacagatcctatgtttttaaaaaatgccgctagtcaattgggttatttcccaatattcccatggattgactctgtcacaggtgtccttgatttaacagtgcaaggattaacagggcaaaaaactgggttgtctgagacgaaggaatctcggtttagaaacatgttaactacctcattgatgtccattagacgtattgctctcaagaattacaaggcttttgtttccaccggtgatgggacagttaatgttaaggaagaagattacctacagcaacatccggaagctaaacccgttatcgtcatagataggtttgagggcaagtcggaaataaatggatttgtgtataaggaactatccgattgggcagctatgctagttcaaatgaatattgctcatgtgattttcttaacggaaaccgttgcatccaaccaaagattgagcgaatcactacccaatcaagtcttcaaaaacctaatcctatcagatgcctcaaaagagaattcgaggaactatgtattatcccaattggaggattacttatattacaataaaaaatccaagggtgaaaacgtaaaagaacctgaatcagaaaaggaaactgctgaaaataatgattctgatagtgaggccgatacgagtgtcaaaaaagctgaggttattttaaatgaaaaggaattacaggaaattgacgcttctttagagccattgggtggtaggatgttagacttacaggcatttgtaagaagggtaaagtcaggagaagagccctcggaagcagtagacaaaatgattgaacaggcttctgagcaaataactcaaatgtttttaagtgacaagattgacagcaataaaagtgcacaagcctgggaattaatcgaattattgagtgcgaacccagtcattccattccatgaaatcgttaacaagccattattcaaagccgcaccagaaacgggaatcatggaattggagaataatggtttaataactgtatctagagataggggtgttttacaggaaatcaggcctgccaaaccgctatacagggcagcattcacatacttgatcaacgatcctgaactcgcaaaagtgctaaaaacccgttacttattaaaggttgtgggttttgaaactggtagaatcaagaaatgggaagaagaattaaaacctttggggaaagttcctgatcagaaacttttcaagaccagattggactatttatccggtaaaatcaatgccagtaatgcagtcattaccaaatgtgaagaagaaattaaaaacctatctaagtga

SEQ ID NO: 351 - DNA, 3273 bp, Saccharomyces cerevisiae
atgtcttctggtttggtcttagaaaacacggcacgtagagatgcgttaatcgccatcgaaaagaagtaccaaaaaatatgggctgaagagcaccaatttgaaatcgatgcgccatcaatcgaagatgagcccattacaatggactctgaagagttacatcgcacgtatcctaaattcatgtcgtctatggcctatccttatatgaacggtgttatgcacgccggccattgttttactctctccaaagtcgaattttctattggttttgaaaggatgaacggtaaaagagctttgtttccattgggttttcactgtacaggtatgccaatcttagcatgtgccgataaactaaagagggaagccgaactttttggcaagaacttcgacaatgtaccagcagaagaagaagaaattaaagaagaaacgccggctgagaaagaccacgaggatgttaccaaattcaaagctaaaaaatctaaagccgcagccaagaagggccgtggtaagtaccaattcgaaatcatgttacagcttggtatccctagagaagaaatcattaagttcgccgacgccaagtactggttgacctatttcccacctttgtgtgaaagtgattgtacttcacttggggctcgtatcgattggagacgttcttttgtcaccactgatgccaatccttattacgatgcctttattagatggcaaatgaacaagttaaaggctgctggtaaaatcaaattcggtgaacgttatactatttactctgaaaaagatggtcaagcttgtatggatcacgatagacaatccggtgaaggtgttacaccacaagaatatattggtgtgaaaattgaagctttagagttcgccgatgatgccgcaaaaatcattgattcaagctcagatcttgacaaatccaaaaaattctactttgtcgctgccacgttgagaccggaaactatgtatggacaaacatgttgttttgtttctccaacaattgagtatggtatatttgacgctggtgattcttattttatcactactgaacgtgcattcaagaacatgtcttaccaaaagctaacaccaaagagaggcttctacaagccgatagttactgtcccaggtaaggcatttatcggtaccaagattcatgccccacaatctgtatatccagaactaagaatattgcctatggaaactgtcattgctaccaagggtactggtgtcgtcacgtgtgtaccatctaattcaccagatgactacattaccaccaaggacttgttgcacaaacctgaatactacggcattaaacctgaatggattgaccatgaaattgttccaattatgcataccgaaaagtatggtgatttaactgcaaaggctattgttgaagaaaaaaaaattcaatctccaaaggataagaacttgttagcagaagccaagaaaattgcttacaaggaagattactacactggtaccatgatatatggtccttataaaggtgagaaggtcgaacaagccaaaaacaaggttaaggctgatatgattgccgccggtgaagctttcgtctacaacgaaccagaatctcaggtcatgtcacgttctggtgatgactgtatcgtttctttggaagatcaatggtacgttgattacggtgaagaaagttggaagaaacaagcaattgaatgtttggaagggatgcaattatttgctcctgaggtaaaaaacgcatttgaaggtgttttggattggttgaaaaactgggctgtttgccgtacatacgggttaggtaccagattgccttgggatgaaaaatacttagttgagtctttatcagactctactatttatcaatcattttataccattgctcacttactatttaaggattattatggtaacgaaattggaccattaggcatttcagctgatcaaatgacagatgaggttttcgattacattttccaacatcaggatgatgtcaagaacaccaatattcctttgcctgctttacaaaagttgagaagggaatttgagtatttctacccattagacgtctcaatttccgggaaggatttgatccctaaccatttaactttcttcatttacacacatgttgcattattcccaaagaaattctggcctaaaggtatcagagctaacggtcatttgatgttaaacaattctaaaatgtcgaaatctacaggtaattttatgactttagaacaaacggttgaaaagttcggtgctgatgcagctcgtattgcgtttgccgatgcgggagatactgttgaagatgcaaattttgacgaatctaacgctaatgctgctattctgagattattcaatttgaaggagtgggcagaagaaattaccaaggaatctaacttgagaactggggaaattacagatttctttgatatcgcgtttgaacacgaaatgaatgctctgattgaaaagacttatgaacagtatgcattgactaattataagaatgccttgaaatacggtctttttgatttccaagctgctagggattactatcgtgaagctagtggtgtaatgcataaagatttaattgcacgttatattgaaacacaagccttattgctggctccaattgcgcctcatttcgctgagtatatttaccgtgaagttctaggtaaccaaacctctgtacaaaatgccaaatttccacgtgcatccaaaccagtagataagggtgttctggctgctttggattacttgagaaatctacagagaagcataagagaaggcgaagggcaagcactaaaaaagaagaagggcaagtctgctgaaatcgatgcatccaaacctgttaagttgactttattgatctctgaatcatttccagaatggcaatcacaatgcgtggaaatcgtccgtaaactattcagcgaacagactttagacgataacaaaaaggtcagagagcatattgagcctaaagaaatgaagagagctatgccattcatttctctattgaaacaacgtttagctaatgaaaagccagaggatgtgtttgaaagagagttacaattcagcgaaatcgatactgtcaaggctgctgcaaggaatgttaagaaggcagcacaagctttgaaaattgctgaatttagcgcaatttctttcccatatggcgccaaaaccggtaaggatatctttactggtgaagaagttgaaattccacctgtaacaaagattgttgaaaatgctgttccaggtaacccaggtgttgtcttccaaaatatttaa

SEQ ID NO: 352 - DNA, 1920 bp, Saccharomyces cerevisiae
atgtctaaagctgtcggtattgatttaggtactacctactcctgtgttgctcacttctctaatgatcgtgttgacattattgccaacgaccaaggtaacagaaccactccatctttcgttggtttcactgatactgaaagattgattggtgacgctgctaagaaccaagctgctatgaacccagctaacactgttttcgacgctaagcgtttgatcggtagaaacttcaatgacccagaagtccaaggtgatatgaagcacttcccattcaagttgatcgatgttgacggtaagccacaaattcaagttgaatttaagggtgaaaccaagaactttaccccagaacaaatctcctccatggtcttgggtaagatgaaggaaactgccgaatcttacttgggtgccaaggtcaatgacgctgtcgtcactgtcccagcttacttcaacgattctcaaagacaagctaccaaggatgctggtaccattgctggtttgaatgtcttgcgtattattaacgaacctaccgccgctgccattgcttacggtttggacaagaagggtaaggaagaacacgtcttgattttcgacttgggtggtggtactttcgatgtctctttgttgtccattgaagacggtatctttgaagttaaggccaccgctggtgacacccatttgggtggtgaagattttgacaacagattggtcaaccacttcatccaagaattcaagagaaagaacaagaaggacttgtctaccaaccaaagagctttgagaagattaagaactgcttgtgaaagagccaagagaactttgtcttcctccgctcaaacttccgttgaaattgactctttgttcgaaggtatcgatttctacacttccatcaccagagccagattcgaagaattgtgtgctgacttgttcagatctactttggacccagttgaaaaggtcttgagagatgctaaattggataaatctcaagtcgatgaaattgtcttggtcggtggttctaccagaattccaaaggtccaaaaattggtcactgactacttcaacggtaaggaaccaaacagatctatcaacccagatgaagctgttgcttacggtgctgctgttcaagctgctattttgactggtgacgaatcttccaagactcaagatctattgttgttggatgtcgctccattatccttgggtattgaaactgctggtggtgtcatgaccaagttgattccaagaaactctaccattccaactaagaaatccgaagttttctctacttatgctgacaaccaaccaggtgtcttgattcaagtctttgaaggtgaaagagccaagactaaggacaacaacttgttgggtaagttcgaattgagtggtattccaccagctccaagaggtgtcccacaaattgaagtcactttcgatgtcgactctaacggtattttgaatgtttccgccgtcgaaaagggtactggtaagtctaacaagatcactattaccaacgacaagggtagattgtccaaggaagatatcgaaaagatggttgctgaagccgaaaaattcaaggaagaagatgaaaaggaatctcaaagaattgcttccaagaaccaattggaatccattgcttactctttgaagaacaccatttctgaagctggtgacaagctagagcaagctgacaaggacgctgtcactaagaaggctgaagaaactattgcttggttagacagcaacaccactgctaccaaggaagaattcgatgaccaattgaaggaattgcaagaggttgccaacccaatcatgtctaaattgtaccaagctggtggtgctccagaaggcgcagctccaggtggtttcccaggtggtgctcctccagctccagaagctgaaggtccaactgtcgaagaagttgattaa

SEQ ID NO: 353 - DNA, 3834 bp, Saccharomyces cerevisiae
atgacgcttggtaacagttatgacgcttttaatcatgatccttggatggatgtggtgggatttgaggatccaaatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatcaccaaaaaatctcaagagtaacgcgaaaaaggccccgagagcccaagagtacaaacgatatcctcgttgcaggccagaaactctttggcagctcctttgaattcagggacttgcatcagttgcgcttatgttatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgatgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaaatcgatggacatcaacgagctcaaacggtcggaagatctcagcagaggtctatccagctatccaacacggatgtttaatctaatcaaggagaaatccgaggtgcctttagggcatgttcataaaattcggaagaaagtggaatcacagcccgaagaagcactgaagcttcttttagccctctttgaaagtgaaccagagtcgaaggccattgtagttgcaagcacaaccaacgaagtggaagaattggcctgctcttggagaaagtattttagggtggtatggatacacgggaagctggatgctgcagaaaaggtgtctcgcacaaaggagtttgtcacggacggtaacatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctaacttccaggagagcaatagcagtgacaggtacagaaagtattgcagcagtgatgaggacagcaacacgtgcattcatggtagtgctaatgccagtactaacgccagtactaatgcgattaccactgctagtaccaacgtcaggactaatgcgactaccaatgctagtactaatgcgactaccaatgccagtaccaatgcgactaccaactccagcactaatgctactaccactgccagcaccaacgtcaggactagtgctactaccactgccagcatcaacgtcaggactagtgctactaccactgaaagtaccaactccagcactaatgcgactaccactgccagcatcaacgtcaggactagtgctactaccactaaaagtatcaactccagcactaatgctactatcactgaaagtaccaactccaacactaatgctactaccactgaaagtaccaactccaaaactagtgctactaccactgctagcaccaactccaacactagtgctactaccaccgaaagtaccaactccaaaactagtgctactaccactgctagcaccaactccaacactagtgctactaccaccgaaagtaccaactccaacactagtgctactaccactgctagcaccaactccagcactaatgctactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacatatacttctgcccagagggcgtattcacacaatacggattatgcaagggctgtcaaaagatgttcgagctctgtgtctgttgggctggccagaaagtatcgtataggaggatggcttgggaagcactagctgtggagagaatgctgcgaaatgacgaggaatacaaagaatacttggaagacatcgagccatatcatggggaccctgtaggatatttgaaatattttagcgtaaaaaggagagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccaggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagcctaggaatgcacttgcgagatcagattgcgctgggagttaccccatctaaagtgccgcattggacggcattcctctcgatgctgatagggctgttctacaataaaacatttcggcagaaactggagtatcttttggagcagatttcggaggtgtggttgttaccacattggcttgatttggcaaacgttgaagttctcgctgcagataacacgaaggtaccactgtacatgctgatggtagcggttcacaaagagctggatagcgatgatgttccagacggtagatttgatataatattactatgtagagattcgagcagagaagttggagagtga

SEQ ID NO: 354 - DNA, 2880 bp, Saccharomyces cerevisiae
atgactgttactactccttttgtgaatggtacttcttattgtaccgtcactgcatattccgttcaatcttataaagctgccatagatttttacaccaagtttttgtcattagaaaaccgctcttctccagatgaaaactccactttattgtctaacgattccatctctttgaagatccttctacgtcctgatgaaaaaatcaataaaaatgttgaggctcatttgaaggaattgaacagtattaccaagactcaagactggagatcacatgccacccaatccttggtatttaacacttccgacatcttggcagtcaaggacactctaaatgctatgaacgctcctcttcaaggctacccaacagaactatttccaatgcagttgtacactttggacccattaggtaacgttgttggtgttacttctactaagaacgcagtttcaaccaagccaactccaccaccagcaccagaagcttctgctgagtctggtctttcctctaaagttcactcttacactgatttggcttaccgtatgaaaaccaccgacacctatccatctctgccaaagccattgaacaggcctcaaaaggcaattgccgtcatgacttccggtggtgatgctccaggtatgaactctaacgttagagccatcgtgcgttccgctatcttcaaaggttgtcgtgcctttgttgtcatggaaggttatgaaggtttggttcgtggtggtccagaatacatcaaggaattccactgggaagacgtccgtggttggtctgctgaaggtggtaccaacattggtactgcccgttgtatggaattcaagaagcgcgaaggtagattattgggtgcccaacatttgattgaggccggtgtcgatgctttgatcgtttgtggtggtgacggttctttgactggtgctgatctgtttagatcagaatggccttctttgatcgaggaattgttgaaaacaaacagaatttccaacgaacaatacgaaagaatgaagcatttgaatatttgcggtactgtcggttctattgataacgatatgtccaccacggatgctactattggtgcttactctgccttggacagaatctgtaaggccatcgattacgttgaagccactgccaactctcactcaagagctttcgttgttgaagttatgggtagaaactgtggttggttagctttattagctggtatcgccacttccgctgactatatctttattccagagaagccagccacttccagcgaatggcaagatcaaatgtgtgacattgtctccaagcacagatcaaggggtaagagaaccaccattgttgttgttgcagaaggtgctatcgctgctgacttgaccccaatttctccaagcgacgtccacaaagttctagttgacagattaggtttggatacaagaattactaccttaggtcacgttcaaagaggtggtactgctgttgcttacgaccgtatcttggctactttacaaggtcttgaggccgttaatgccgttttggaatccactccagacaccccatcaccattgattgctgttaacgaaaacaaaattgttcgtaaaccattaatggaatccgtcaagttgaccaaagcagttgcagaagccattcaagctaaggatttcaagagagctatgtctttaagagacactgagttcattgaacatttaaacaatttcatggctatcaactctgctgaccacaacgaaccaaagctaccaaaggacaagagactgaagattgccattgttaatgtcggtgctccagctggtggtatcaactctgccgtctactcgatggctacttactgtatgtcccaaggtcacagaccatacgctatctacaatggttggtctggtttggcaagacatgaaagtgttcgttctttgaactggaaggatatgttgggttggcaatcccgtggtggttctgaaatcggtactaacagagtcactccagaagaagcagatctaggtatgattgcttactatttccaaaagtacgaatttgatggtttgatcatcgttggtggtttcgaagcttttgaatctttacatcaattagagagagcaagagaaagttatccagctttcagaatcccaatggtcttgataccagctactttgtctaacaatgttccaggtactgaatactctttgggttctgataccgctttgaatgctctaatggaatactgtgatgttgttaaacaatccgcttcttcaaccagaggtagagccttcgttgtcgattgtcaaggtggtaactcaggctatttggccacttacgcttctttggctgttggtgctcaagtctcttatgtcccagaagaaggtatttctttggagcaattgtccgaggatattgaatacttagctcaatcttttgaaaaggcagaaggtagaggtagatttggtaaattgattttgaagagtacaaacgcttctaaggctttatcagccactaaattggctgaagttattactgctgaagccgatggcagatttgacgctaagccagcttatccaggtcatgtacaacaaggtggtttgccatctccaattgatagaacaagagccactagaatggccattaaagctgtcggcttcatcaaagacaaccaagctgccattgctgaagctcgtgctgccgaagaaaacttcaacgctgatgacaagaccatttctgacactgctgctgtcgttggtgttaagggttcacatgtcgtttacaactccattagacaattgtatgactatgaaactgaagtttccatgagaatgccaaaggtcattcactggcaagctaccagactcattgctgaccatttggttggaagaaagagagttgattaa

SEQ ID NO: 355 - DNA, 420 bp, Saccharomyces cerevisiae
atggttcagttgagcacatacttaccatcacctccctcgacaaatatgtcctgcacattctcgagtgtgatgagtgtctgctttatgaccatgtcggcaactgtgctgccgatatgtggcaaagctgtaacatcccatctgcgaagtaactcttgcttaacgcgtgtttcctcatttttaaacacatcgagaccacagcttgccacttttccagattcaagagcgtctagtagcacatcttcatctatgcatgtgcctctcccaacgttaactatcctgacaccatctttacaccaggccaaacttttacgattgataatattgtttgtagaggccgtactgggcaaggccaaaatgatcaaatccgcattcttccaagtatttggatcatctagatcagaatggtacttagcgttgtaa

SEQ ID NO: 356 - DNA, 2382 bp, Saccharomyces cerevisiae
atgcaagtactagtgacgctctggtgtctaatatgcacatgcctggtactaccagtggccgccaagaaaaggacactgacagcgagttcactggtcacgtgcatggagaactcacagctttcagccaatagtttcgatgtgtcgttttctccagacgatcgatcgctacattacgatctggatatgaccacgcagatcgactcttacatctacgcttatgtggacgtgtatgcctacgggttcaagattattacggagaacttcgacgtgtgttcaatgggttggaagcagttttgccctgtgcacccaggtaacatacaaatcgactccattgaatacattgcccagaagtacgtgaaaatgattccgggaattgcctaccaagtgcccgatattgatgcgtacgtaagattgaacatttataacaacgtaagtgaaaatttggcttgtatccaggttttcttttccaatgggaaaactgtatcacaaattggggttaaatgggtgacagctgttatcgccggtattggtttattaacttccgctgtcttgtccaccttcgggaactccacagcagcatctcacatttctgcaaacaccatgtcactgttcttatatttccaatctgtcgctgtggtcgcaatgcaacatgtagacagtgttccacccattgctgctgcctggtctgaaaaccttgcctggtcgatgggcttgatccgtattacatttatgcagaaaatcttccgttggtatgtagaggcgactggaggctccgcatctctatatttgaccgcgacaacaatgtcagtgctcactcaacgaggtctggattaccttaaaaatacttcggtttacaagagggcggaaaatgtcttgtacggtaactcaaacactttaatctttcgaggaattaaaagaatgggataccgtatgaagattgaaaatacggccatcgtttgtactgggttcacattctttgtgctgtgcggttattttttggccgggtttatcatggcctgcaaatacagtatcgagttatgtataagatgtggttggatgcggagtgataggttttaccaatttaggaaaaactggaggtcagttctgaaaggatcgttgttaagatacatctatattgggttcacgcaactgacaattttaagtttttgggagttcactgaacgggattccgccggtgttattgttattgcatgcctattcattgtattgtcatgcgggttgatggcgtgggctgcgtacagaaccatttttttcgcaagtaaatctgtggaaatgtacaataacccagctgctttattgtatggtgatgagtacgtcttaaacaagtacgggtttttctacaccatgttcaacgcaaaacattattggtggaatgctcttttaacgacgtatattcttgtaaaagctttatttgtcggattcgcacaggcatcaggtaaaacgcaagcattggctattttcattattgacttggcgtattttgttgccatcatccgttataaaccatatttggaccgtccaacgaatattgtcaacatttttatttgcactgtcaccttggtcaactctttccttttcatgtttttctcaaacttgtttaaccaaaagtatgctgtctctgccatcatgggctgggtgtttttcattatgaatgctgcgttttctttgcttctactgttgatgattctggcctttaccacaatcattctgttttctaagaatcctgactccaggttcaagccagcaaaggatgacagagcatctttccaaaagcatgctattcctcatgaaggtgccttgaataagtcagtggccaacgaattaatggccctaggtaatgtggcaaaggatcataccgaaaattgggaatacgaactgaagagtcaagaaggtaaaagtgaagataatcttttcggagttgaatacgatgacgagaaaacaggaactaattcagagaatgctgaaagtagcagtaaggaaaccacccgtccaaccttttctgaaaaggttttacgttcattatcaatcaaaaggaataagagtaaactgggcagtttcaagcgcagcgctccggataagataacacaacaagaggtttctcctgaccgcgccagctcttcgcctaacagcaagtcataccccggtgtctcgcacaccaggcaagaatctgaagcgaataatgggctaatcaatgcatatgaagatgagcaattcagtctgatggaaccaagcatactggaagacgctgctagttccacccaaatgcatgctatgccagcccgagatttgagcttgagcagtgttgcaaacgcccaagatgttactaaaaaagcaaacatcctggatcctgattatttgtaa

SEQ ID NO: 357 - DNA, 4329 bp, Saccharomyces cerevisiae
atgactgcttctgacctcttgacgctcccacaattgttggcgcaatattcctctagtgctccccaaaataaagtgttctacactactagcacaaaaaatagtcattcatccttcaaagggctagaatctgttgccacagatgctactcatctattgaacaatcaagatccattgaataccatcaaagatcaactctctaaggacattttaactaccgtttttacagatgaaactactttggtcaaatccatccaccatctatattctcttcctaataaacttccattggtgattacagtggatttgaatttgcaagattattccgcaattcctgcgttaaaggatctttctttccccatcttaatatcttctgatttgcaaactgcaatttcaaacgcggactcttcttataagattgctacaagttctctgaccccagttttccattttcttaacttggagaaaattggcacgagtacagctattgaacaagacatcgactttcctaccttggagattgctaacgaagagactaaagtagcattatcagaagctactgattcattgacaaattttgaactggttaaaggtaaagagtcaattaccactgtcattgttaacctgtcaccatatgacgcggaattcagtagcgtattgccttcaaacgtaggattgatcaagattagagtatacagaccatggaatttttccaagttcttggaaatactgccatcttctgttaccaaaatcgccgttttacagggtgtctctaagaaatcgcaatcaaacgaatttcaaccatttcttttggacttctttggcaattttaatgaattagtttctaggaacatcgagcaggtagtgttgactaatattggtaatgtgaatgattatggcaacgttatcaacaccgtcatatcgaatattaacaagaaggaaccagataataacttatttttaggtgaatccaatgaaaaggctgaggaacaagctgaagttactcaacttatttcttctgtcaaaaaagttgtgaacttagaagacgcctatatcaaagtgctaaaacagttattttcatcaaatctacaaattttgaatcaattttccagtgagacaattgaaccaagtaatccagaatttggttttggacgctttttaaaacaagaagcccagcgtgaagaattgatcagcttagcaaaaacctctcttgatccaagtctttacttgtccgaggatgcaaataaaattgttcaactattatctaaatggttgtcattcaatggacgcgatcttgacgaagctcaattacaagaggccaatgcgacaggtttggaaatatttcagttattacaatctaatcaagattcctctactgtcttaaaattcttaaagatagctccaacaagcgattcttttattttcaaatcaagctggctaattggctccgatgcctggtcttatgatttgggtcactcaggtattcaacaggttttatcctcccgtaaaaacattaatgttttattgattgattcagagccatatgaccatagaaagcaaaaccaggatagaaagaaagatgttggtttgtacgccatgaattattacagtgcctatgttgcctctgtagcagtatatgcttcttacacccaactattgactgcaataatagaggcatctaaatacaatggtccttctattgtcttggcttatttgccgtataattccgaaaatgatactccattagaagtcttaaaggaaaccaaaaacgccgttgaatctggttactggccattgtataggtttaatcctgtttatgacgatccatcaacagataaggaggcatttagcttggattcttcggttatcagaaaacaattacaggacttcttagaccgtgagaataagcttaccctattaaccagaaaagatccatctttgtcaagaaatctaaagcaatctgctggtgatgcgttgacaaggaaacaagaaaaaagaagcaaggctgccttcgatcagttattggagggtttgtccggcccaccgctacacgtctattatgcttctgacggtggtaatgctgcaaacttggcaaagagactagcagcaagggcatctgcaagaggtttaaaggctactgttctgtccatggatgacattattttggaagaattacctggtgaagagaatgtagttttcattacttccacggctgggcaaggtgaattcccccaagacggtaagtctttctgggaagctctgaaaaatgacaccgacttggatttagctagtttgaatgttgctgtttttggtctcggtgattctgagtattggccacgtaaagaagataaacattattttaacaagccttcacaggatttatttaagcgcttggaattattgagtgccaaagccctaattcccttgggactgggtgatgatcaagatgctgatggtttccaaactgcttattctgagtgggaacctaaattatgggaagctcttggtgtttccggcgctgctgttgatgatgagccaaaacctgttacaaacgaggatattaagagagaatctaatttcttgagaggtactatcagtgagaacttaaaggatacttcttcaggtggtgttactcacgctaatgaacaattaatgaaatttcacggtatttacacccaagacgatcgtgacattagagaaatacgtaagtcacaaggcttagagccatactatatgtttatggcaagagctcgtttaccaggtggtaagaccactccacaacaatggcttgctctggatcacttatctgatacttcaggcaatggtaccctgaaattaacaacaagggcaaccttccagattcatggtgtgctaaagaagaacttgaaacacacattgagaggaatgaatgcagttcttatggatacattagctgctgcaggtgacgtgaacagaaatgtcatggtttctgctctaccaaccaatgccaaggttcaccaacaaatcgctgatatgggaaaattgatttctgatcatttcttaccaaagactacggcctaccacgaagtttggctggagggcccagaagaacaggacgatgatccatcctggccatctatttttgaaaacagaaaagatggtccaagaaaaaagaagactctagttagcggtaacgctttggtcgatattgaaccaatttacggtccaacttatctgccaagaaagtttaaattcaacatcgccgttcctccatataacgatgtggatgtattatctatcgatgtcggtttagttgctatagttaacccagaaactcaaatcgtggagggttataatgtttttgttggtggtggtatgggtaccactcataacaacaagaaaacttacccaagattagggtcatgcttaggttttgttaaaactgaagacattattccaccacttgaaggtatcgttattgtccaaagagatcacggtgaccgtaaagaccgtaagcatgctcgtttaaagtatactgtagatgatatgggtgtcgaaggcttcaagcaaaaagtggaggaatactggggtaagaaattcgagcctgagagaccatttgagtttaaatctaatattgattactttggatggattaaagatgaaactgggttaaaccactttaccgcatttattgaaaatggtagggttgaagatacaccagatttgcctcaaaagacaggtattagaaaggttgctgaatacatgcttaagactaattctggtcatttcagattgactggtaatcaacatttggttatctctaatattacagatgaacatgttgctggaataaaatctattttaaagacctataaattggataacaccgatttcagcggtttgagattatcttcatcttcctgtgttggtttgccaacatgtggtttagcgtttgccgaatctgaacgtttcctacctgacattattactcagttggaagattgtttagaagagtatggtttacgccatgattccattattatgagaatgactggttgccctaacggttgttctcgtccatggctaggtgaattagctcttgttggtaaagctccacatacttataacttgatgcttggtggtggttacctcggccaaaggctaaacaaattgtataaggccaatgtgaaggatgaggaaattgtcgactacatcaaaccattgtttaaaaggtatgctttagaaagagaagaaggggaacactttggtgatttctgtataagagtaggtatcattaaaccaaccaccgagggtaaatacttccatgaagatgtgtctgaagatgcctattaa

SEQ ID NO: 358 - DNA, 1026 bp, Saccharomyces cerevisiae
atgcaatacaaaaaatcattagttgcctccgccttagttgctacatctttagctgcctatgctccaaaggacccgtggtccactttaactccatcagctacttacaagggtggtataactgattactcttctactttcggtattgctgttgaaccaattgccactactgcttcctccaaggctaagagagccgctgctatctctcaaattggtgacggtcaaatccaagccactaccaaaaccactgctgctgctgtttctcaaattggtgacggtcaaatccaagccactactaaaaccaaagctgctgctgtctctcaaattggtgacggccaaatccaagccaccaccaagactacctcagctaagactaccgctgcagccgtctcccaaattggtgacggtcaaattcaagccactactaaaaccaaagctgctgctgtctctcaaattggtgacggtcaaatccaagccactaccaaaacaactgctgcagctgtctctcaaattggtgacggtcaaatccaagccactactaaaaccactgctgctgctgtttctcaaattggtgacggtcaaatccaagccaccaccaatactactgttgctccagtctcccaaatcactgatggccaaatccaagccacaactttaacttctgcaaccattataccatctccagctccagctccaattactaatggcactgacccagtaactgctgaaacatgtaaaagcagtggcactttagaaatgaacttaaagggtggtatcctgactgacggtaaaggtagaattggttctatcgttgccaacagacaattccaattcgatggtcctccaccacaagctggtgctatctatgctgctggttggtccatcaccccagaaggtaacttggccatcggtgaccaggatactttttaccaatgtttgtcaggaaacttctacaacttatacgatgagcacattggaactcaatgtaatgcagtccacctacaagctatcgatttgctcaactgttaa

SEQ ID NO: 359 - DNA, 1401 bp, Saccharomyces cerevisiae
atgaagatcttttgggatcctagatcggtaatagaacatcaggattactctggacctgctaacgtgtttcatcttcttttcacttctctgcccacgatgtctgctgaaaccgccgccgcaaacactgctactgccccagtcccagaagtgcaagaacaagagagctccaagagcaagcaagtcaacttgacgccggcaccattgcccacatcttccccatggaaacttgctcctactgagatccctgtttctactatctcaatagaagacttggatgccacaagaaagaagaagaacagaacacccactccgaaatcatcgactgctaccaagtgggttcccatcaaggcctccattaccgtctctggcaccaaaagatccggttccaagaatggtgcaagtaatggcaacagcaacaagagcaaaaacaacaaaactgcagcatcgtcgacatcgtcgagtaatgctaacaggaaaaagaagcatcaccaacataatgctaagaagcaacaacaaatgaagaaagatggctttgaatcggcagtaggtgaggaagattcaaaagacgctacctctcaagaaaatggtcaatctacacaacagcaacaaccacctcaccaccgtaatcatcaccacagtcatcaccataacagcaatggtcctcaaaggagaaagttccacaacagtaataacgccggtatgcctcagaaccaaggcttcccaccacagtttaaaccttaccaaggacgcaacgctcgtaataacaacaacaaccgctctaaataccacaaccacttccatcacaaccaacaacatcctcaacaacctatggtcaaattacagcaacagttttatccagtccaaccagtgttaatggccatcaacaacattgctagacaaattgaatactatttcagcgaagaaaacttgaccgtcgacaattacttaaggtccaaactctccaaggatggttttgctccattgtctttaatctctaagttttacagagttgttaacatgtccttcggaggtgacactaacctgattttagccgcattgagagaaattgtcgctaacgaagccgctaccgtcaatgttgcagaaggtactttggccgccaaggaaggtgataacgttaccggtgaagccaaagaaccatctccattggataagtacttcgttcgttccaagagctggtcaaactggttaccagaaacttttgaaactgaaattaatattgaaaaagaactggtcggcgatgcattggaccaattcatgatatccctaccacctgttcctcaacaagaagaggaatcatccactgaactcgcttctcaagaacaagaaaccaaagaagactctgcgccggttgctgccggtgaatccgagtcttccttataa

SEQ ID NO: 360 - DNA, 3090 bp, Saccharomyces cerevisiae
atgactttagattacgagatttacaaagaaggaggtattttgaataatcgatatcaaaaaatagaggatatcagtgaaggttcatatggttatgtatcattggctaaagatgttagagagaaaagattggttgcagtcaaatacattttcaaattagaagatgacggccagtacgatgggcctcaggacgacgaaaatgattgtgatagtagcgattgtgatgatgatgaagacacgaaagttgatacggatcgccatgaaaatgaaaatggtaatgcctccagtaataacgggtcaagtagagagaagaaacacaatctctacaaacacaaaaagtccctaatttcttcgaaagttaaatcaagactatctaataacatttgtctcgaagccatgtatgaagttgatattcaaacaaaaattggtagacaccaaaatattgctgctctattagatttcttcgactcttacatcatcatggaatattgctctggcggtgacctatatgaggcgatcaaagccgatgctgtgcctaagaaaaccaaatcgatcactcatattatcacacaaatcatggatgcaattgaatatgttcataacaagggcatttatcatcgtgatataaaacctgagaacattttaatttctggaattgattggacaattaagcttacagattggggattggctactacagataagacgtctatggatagaaatgtcggtagtgaaagatatatgtcccctgaactttttgatagtaatttggatatcaaggaaagaaaggaaccttatgactgtgccaaagtggatttatgggctatgggaattgtgtttcttaatattgttttccataagaatccttttagtattgccaatcaatccgacaagtcattctgttattttgctgctaatagagaagcgttgtttgatgtattttcgacaatggcttatgatttctttcaagtattaaggtatagtttaaccatcgatccggctaatagagacttgaaaatgatgagaactgaactacagaacttatctgagtatacattagacgatgaatactataataacttggatgaaggatatgaagaaactatgattgacggtttgccacctcagcctgttcctccatcttcagcaccggtatcattacctactcctatttcatctagtaacaaacaacatatgcctgaatttaaaaaggatttcaatttcaataatgtgaatgaaaggaaacggtcagatgtctctcaaaatcaaaatgttgcaagcggcttctttaaaaaaccgtctacacaacaacagaaatttttcaaccagggttataatacaacactatctactcatgaaagggctaaatctgctcctaagttcaaatttaagaagcgcaataagtacggaagaactgataatcaattttccaaaccagtcaatatcgaagatagaaagaaaagtaaaattttgaaaaaatcaaggaagcctcttggcataccaacgcctaatacacacatgaataattttttccacgattacaaagcaagggatgaattcaacaccagagattttttcactcctccaagtgtccagcacaggtatatggaggggttttccaacaacaacaataaacagtacagacagaatcgtaattacaacaataataacaacaacagcaataacaatcatggaagtaattataataattttaacaatggtaatagctatataaagggttggaacaaaaactttaacaaatacagaagaccaagttcctccagttataccggtaagtcaccactttcaaggtacaacatgagctataatcataacaacaatagttctataaatggttatgcaaggcgtggttctacgactacagttcaacattcaccaggcgcttatattccaccaaatgccaggaaccatcacgtaagcccaacgaatcagtttttaagagttccgcaatcaactgctcctgatatctctaccgttttaggtgggaagccttcataccaggaacactacactcaggatagtatggattctgagggcgatcacgattcagacgacgttttattcactcttgaagaaggtgatcatgatttcgtcaatggtatggacaacttatctataaatgatcacttaccgcatacaacggtaggtagccataatgaagtatttgttcacgcaagcactaatcacaataacaatggcaacaacaaccatatcgacaccaatagtaccactaatcaatatcatagacaatatattccacctcctttgacaacatcattgcatatcaacaataacaataatgaatctaatgaactaccagatttactaaaatcaccagcatcatctgaagcacatttaaatttatcttctggaccaattgatccaattttaacaggtaatattggcaatcgatattcacactcatctgactctaaggagctagagcaggagcgtagactcagtatggaacaaaaatttaaaaatggggtttatgttccacctcatcataggaagagtttcaacttgggaacacaggtacctcctatgaatatgaagacaagtaacgaggccacgttgtcagtttcgcataattctgttaattttggtggatcttacaattccaggcgttccagtgctaatgaatctaacccactgcatatgaataaagcactcgagaagttgtcctcttcaccaggagctaaaagctccttcgttggcttccctaaacctttattacctcgtaatcattcaagcactacgattgcgttgcaaaatgaagacgtattcgcagactctaacaatgacgccataattttcgaagacgaagaatacgaaggagaaagtgacaagatggcacatggcaaaatggaaggtggtgacaacgaatcctcgtcaacctccccggatgaaaggcaaattttcggtccttatgaaatttatgctcaaactttcgctggctccactcacgataaaaaattaggagctggcaggaagacaagtattcaggatgaaatggtcggatcgttagaacaatacaagaataattggttaattttacagcaacaagactaa

SEQ ID NO: 361 - DNA, 2043 bp, Saccharomyces cerevisiae
atgactcaattcactgacattgataagctagccgtctccaccataagaattttggctgtggacaccgtatccaaggccaactcaggtcacccaggtgctccattgggtatggcaccagctgcacacgttctatggagtcaaatgcgcatgaacccaaccaacccagactggatcaacagagatagatttgtcttgtctaacggtcacgcggtcgctttgttgtattctatgctacatttgactggttacgatctgtctattgaagacttgaaacagttcagacagttgggttccagaacaccaggtcatcctgaatttgagttgccaggtgttgaagttactaccggtccattaggtcaaggtatctccaacgctgttggtatggccatggctcaagctaacctggctgccacttacaacaagccgggctttaccttgtctgacaactacacctatgttttcttgggtgacggttgtttgcaagaaggtatttcttcagaagcttcctccttggctggtcatttgaaattgggtaacttgattgccatctacgatgacaacaagatcactatcgatggtgctaccagtatctcattcgatgaagatgttgctaagagatacgaagcctacggttgggaagttttgtacgtagaaaatggtaacgaagatctagccggtattgccaaggctattgctcaagctaagttatccaaggacaaaccaactttgatcaaaatgaccacaaccattggttacggttccttgcatgccggctctcactctgtgcacggtgccccattgaaagcagatgatgttaaacaactaaagagcaaattcggtttcaacccagacaagtcctttgttgttccacaagaagtttacgaccactaccaaaagacaattttaaagccaggtgtcgaagccaacaacaagtggaacaagttgttcagcgaataccaaaagaaattcccagaattaggtgctgaattggctagaagattgagcggccaactacccgcaaattgggaatctaagttgccaacttacaccgccaaggactctgccgtggccactagaaaattatcagaaactgttcttgaggatgtttacaatcaattgccagagttgattggtggttctgccgatttaacaccttctaacttgaccagatggaaggaagcccttgacttccaacctccttcttccggttcaggtaactactctggtagatacattaggtacggtattagagaacacgctatgggtgccataatgaacggtatttcagctttcggtgccaactacaaaccatacggtggtactttcttgaacttcgtttcttatgctgctggtgccgttagattgtccgctttgtctggccacccagttatttgggttgctacacatgactctatcggtgtcggtgaagatggtccaacacatcaacctattgaaactttagcacacttcagatccctaccaaacattcaagtttggagaccagctgatggtaacgaagtttctgccgcctacaagaactctttagaatccaagcatactccaagtatcattgctttgtccagacaaaacttgccacaattggaaggtagctctattgaaagcgcttctaagggtggttacgtactacaagatgttgctaacccagatattattttagtggctactggttccgaagtgtctttgagtgttgaagctgctaagactttggccgcaaagaacatcaaggctcgtgttgtttctctaccagatttcttcacttttgacaaacaacccctagaatacagactatcagtcttaccagacaacgttccaatcatgtctgttgaagttttggctaccacatgttggggcaaatacgctcatcaatccttcggtattgacagatttggtgcctccggtaaggcaccagaagtcttcaagttcttcggtttcaccccagaaggtgttgctgaaagagctcaaaagaccattgcattctataagggtgacaagctaatttctcctttgaaaaaagctttctaa

SEQ ID NO: 362 - DNA, 1572 bp, Saccharomyces cerevisiae
atgtaccaaaataatgtattgaatgctattttggcttctgaaaaatcaaactttcaatacgatagtggaacaatattaagaaaccacaaaagaccaataataacatttaataacaacatagagcacacagtatccgaacctaataattttacaggctatgaggaaaaggaagatttggatataatggatatttgtccttattacccaaaagcaagaatgctggcggatgccattcaacatgccaaaacgagcgcaagtgaaaacaaaatggaactatcaatgaaaactatcccatgtctcaagaaggaaaacgtccatgttgagaaagggcacgattggtctcaactcagtacgagcagaatttgtaaaattttagaagacatagcagataaaaaaaataaaactagaaggcaatctgccccattacaaaagacgaagtatttcccaacaaatgagaatcaaaataccgatatagaaaatcagaattggtcccaaatccccaatgaagacatatgtgcacttatagagaagattgctagcagacgcaataaaaatcgcaaacggaaaaatctttcatgttctaaagtccaagaaattcagggaaatattgatttacccaaaaaagacgtacaagagggagatatttcagattcgtctctatttgcagcagtaagaggaaccaaaaaagtttccggatatgattacaattcagaagataagatacctaatgcgatacgtcttccttactgtaagcaaatattacgattattctcacttttacaaatgaagagaaatgacttaatagtcacctctgaaaattgtaatagcggagttttcttcagcaattttaattatcaacttcaagttaaatcgaattgtattgcaaatatttcttctacactcagttttctaccccatcatgaaataaccgtatacacatcctttattctctatccaaacgttgtcgataatatttgggaatgcacacgatacgctattcaacttttgaagtccgaagcagcacagtttacgctactgcgtgatatatatagtggcttcacaattatactttcaaatcatcgatatcatcctaagggttttagcgctgattactgttacagtgcaaatgaattgacattatttctttttgttattcgaacagggcaaaaaaaagtactttatcgatctattcctcacaacacagcagcaattgaaaaagacagttcttttgatacagaaaatagaaagagaaggtccgaggaagaggttgttcttaaatgtaggaagtgttctaataattcattggcattaaaagaaatcagcacctatcgtttggatagcgcagaaggttttgagaagtctcagcctctaaaagatgaagcaaagctcagtgatatgaattatgtacaaggtagtatcagctataacaggactattcttaccggcttatggaaattatttcacagattgtgctgcaaagatcgttataggaaaaccaatctgtcagaaacattgttctatgacgattcaacggaaagatgggttagaatgggagagttaatgcactattga

SEQ ID NO: 363 - DNA, 1770 bp, Saccharomyces cerevisiae
atgactatttcttctgcacatccagaaacagaacccaagtggtggaaagaggccacaatctatcaaatttatcccgcaagtttcaaagactccaacaacgatgggtggggtgatatgaagggtattgcctccaagttggagtatatcaaagagcttggtgccgatgccatttggatctcaccattctacgactcgccacaagatgatatgggttacgatattgccaactacgaaaaggtctggccaacctacggtacgaacgaggactgctttgccttgatcgaaaagacacataagcttggtatgaaatttatcaccgacttagtcatcaaccattgctcgagcgaacatgaatggttcaaagagagcagatcctcaaaaaccaatccaaaacgtgactggttcttctggagacctcctaagggttatgacgccgaaggcaagccaattcctccaaacaattggaggtcttacttcggtggttctgcatggacgttcgatgaaaagacacaagagttttacttgcgtttgttttgctccacccaacctgatttgaattgggagaatgaggactgtagaaaggcaatctacgaaagtgccgttggatactggttagaccatggtgtagacggctttagaattgatgtgggaagcttgtactccaaggttgctggtctaccagacgctcctgtgattgacgaaaactcaaagtggcaacccagtgatcctttcacaatgaacggaccacgtatccatgagtttcatcaagaaatgaacaagttcatcagaaacagagtgaaggatggcagagaaattatgacagttggtgaaatgcaacatgctactgatgaaaccaagaggttgtatacaagtgcatcaagacacgaacttagtgagttattcaacttttcccacactgatgtcgggacttcgcccaagttccgtcaaaatttgatcccatatgaactaaaggattggaaggttgcccttgctgaacttttcagatacgttaacggaactgattgttggtcaacaatttatctggaaaatcacgaccaacctcgttcaattaccagatttggtgacgattctcctaagaaccgtgttatttctggtaagttgttgtctgtgttgttggtgtcactgagcggtactctatatgtgtaccaaggacaggaactgggtgaaatcaatttcaagaactggcctatcgaaaaatacgaggatgtcgaagttagaaataactatgatgcgatcaaggaagagcatggagaaaactcgaaggagatgaagaggtttttggaagcaattgcccttatttccagagaccatgctagaacacctatgcaatggtctcgtgaggagccaaatgctggtttttctggtcctaatgctaaaccatggttttacttgaacgagtctttcagggaaggaattaacgctgaagacgaatccaaggatcccaactcggttttgaacttctggaaggaggccttgagatttagaaaggcacacaaggatattactgtatatggatatgattttgagtttattgatttggacaataagaaactgttcagcttcacaaagaaatacgacaacaaaacattgtttgctgctttgaacttcagctctgattcgattgacttcacgattccaaacaatagctcgtcgtttaagttggaattcggaaactacccaagaagcgaagttgatgcgtcttccagaacattgaagccatgggagggcagaatttacatatctgaatga

SEQ ID NO: 364 - DNA, 1179 bp, Saccharomyces cerevisiae
atggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgctga

SEQ ID NO: 365 - DNA, 2250 bp, Saccharomyces cerevisiae
atgacttcgaaaccatccaccagtgacggcagggctcactcgatttcccatgtacctggcacgcacatgagaggaacatcggcatcacacagccccagaccgtttaggccatgtgcggattgtacgtgttctccaggcttactgtctaggcaaggtcgtagagcctctctatttttaagacagttagaaaattcaaggaggtcctccagcatgcttctcaacgagttgaagggcgctggcggaggtagcagtgctggaaatgggtctgtttactcatgtgactctctatgcgctgttaacagggaagttaacactactgatagattgttgaagttgcgtcaggagatgaagaaacacgatttgtgttgttatattgtgcccagttgtgacgaacatcagtccgaatatgtatcattgcgagatcaaaggcgcgccttcatttcagggttttccggatcggccggtgtagcctgtatcaccagagacttgttaaatttcaacgatgaccatccggatgggaaatccattttgagtactgatggaagatatttcaatcaagctagacaagaactagattataattggacacttttgaggcaaaacgaagacccaatcacttggcaagaatggtgtgtcagagaagctttggaaatggccaagggacttggcaataaagagggaatggtgttgaagataggtattgacccaaaacttatcactttcaacgactatgtttcttttagaaaaatgattgacactaaatatgacgcaaagggtaaagtggagctggttcccgtggaggaaaacttagttgacagtatttggcctgattttgaaactctacctgaaaggccttgtaacgatttactactgttaaaatacgagtttcatggtgaagaattcaaagacaagaaggaaaagttactgaaaaagctgaatgataaggcttcctctgcgacgaccggtaggaatactttcatagtagttgcgttggatgaaatttgttggttgttgaacttgcgtggatccgacattgactataatccagtttttttctcctacgtggctattaacgaagacgaaaccattcttttcaccaataaccccttcaatgatgacatatcggaatattttaagataaacggtattgaagtcagaccttacgaacagatatgggaacatttaacaaagataacttcgcaggcttcttctgcggagcatgaatttttgattcctgatagtgcatcgtggcagatggttcgttgtttgaacacctcaaccaacgctaacggtgcaatagctaaaaaaatgactgcacaaaactttgcgataattcactcacccatcgatgttttgaaatctatcaagaatgacatcgaaataaaaaacgcacacaaggcgcaggtcaaagacgcagtatgtttagtgcagtattttgcatggctggagcagcaattagtggggcgcgaggcactgatagatgaatatcgtgccgcagaaaaattgaccgagattaggaaaacccaaaggaacttcatgggcaattccttcgaaacaatatcctccacaggtagtaacgccgccatcatacattattcgccgcccgtagagaactcttcgatgattgatcctaccaagatatatctttgcgactccggttcgcaattcttggagggtacaactgatataacaagaacaattcacttaacaaagccaaccaaagaagaaatggataattacacactggtacttaaaggtggcttagccctagagaggttgatttttcccgaaaacactcccgggtttaatatcgacgccatcgctaggcagtttttatggtcccgcgggttagattacaaacatggcacaggccatggtatcggatcatttttaaacgttcacgaaggacccatgggtgtcggctttaggccacatctgatgaatttccccttaagagcgggtaacataataagtaacgaaccaggttattataaggatggtgagtatggtatcaggattgaaagcgacatgttaatcaagaaggccactgagaagggtaacttcttgaaattcgaaaacatgactgtggttccctattgcaggaagttgatcaatactaagttactaaacgaagaagaaaaaacacagattaacgagtaccacgcaagggtatggaggacaatagtgcattttctgcagcctcagagtatttcatacaagtggctgaaaagagaaacaagcccactatga

SEQ ID NO: 366 - DNA, 2646 bp, Saccharomyces cerevisiae
atgagattttcacacttcttgaagtacaatgctgtcccagaatggcaaaaccattatatggactacagcgagctgaaaaatcttatttacacgctacaaacagatgaacttcaggttggtgataacgaagaaggatttggcgcaggaaagagctctaacattacagataggttcaaaaacaagttttcttttaaaaatgcgaaggaagatacgtcttccggtatgaacaaagatgcaggcatcgttgaggaaaccatcgagttgcgagagttgcctactgctcagacggtcgctgccaaaccttctcctttcagaagaatgaaggaaaagatattttacaaaagaaggtcgtcttccgcatcgtccgtctcctccacggccaacgaaaatctgcaattagacacttatgatacgtttgttggtgatttaacagctgaaaaacagaaagtagatgatttttataagaggacagaagcgaagttctacgacaaatttgacgcgctggtgaaggacctgaagaaaatcggagttatagaatacgatatcgacgatgatactctgtttaacgaaccgattgccagcacaaatgacgaagttcccccactagacttggatgatgacgaagacgacgacgaattttacgatgatcaatctaatattgaagataatactgctttgctgcatcattcgcagtataacattaagtctcagaaaaaatcgctgttgaagaagtcgatcgtaaacctatatatcgatctttgccagttgaagtcgttcatcgaattgaaccgcattgggtttgcaaaaattacaaagaaatcagacaaagttcttcacttgaatacaagaaccgaactgatcgaatcggagcagtttttcaaagacacatatgcattccaggcagaaacgatcgaattgctaaattccaaaatttcccagctagtcacattttatgcgcgcatcactgaccggcctcataatatctcgcatagcaagcaagagttgaaatcctacctgcatgaccacattgtttgggaaagaagtaacacttggaaagacatgttgggactgctatcgcaagctgacgagttgacaccaaaggaaacagaatataatgcaaataagctggtaggcaagttagatttggaatactacagatggccactacccagaccgataaacttaaaattcactagtataaacaacgttgcactaccgaaattatttttcaccaagaaagcatacaagatttactttattattctagtcactggactcttgttaggaataaagaccttcaacgacgctgctcagcaccgctgcatggcccttgtcgagtgtgtcgcctttttgtgggctagtgaggccatcccattacacattacagcattccttgtaccactacttgtagtccttttcaaagtcctaaaaacctccgacggggctataatgagtgctgcaagcgcttcatcagaaattttggccgccatgtggtcttctacaattatgattctgctggcaggttttactttgggtgaagtacttgcacaatataacatcgccaaagttcttgcctcgtggttgttggccttcgctggttgtaaacccagaaacgttcttttaatggcaatgtgtgtcgtgttcttcctatcaatgtggatttccaatgtcgcagcacctgttctaacatattcgttgttatctcccctattggatgccatggatgcagatagcccatttgcgcaagcattggtgttaggtgtagcgttggctgcaaatatcggtggtatgtcttcaccaatctcttcacctcaaaacatcatttccatgtcgtacttgaaaccctatggtattggctggggccaattctttgctgttgcattgccatctggtatcctggccatgcttttggtttggattttattgttcactactttcaagatgaataagaccaaattggaaaaatttaagcctattaagacgaaattcacagttaagcagtattatatcattactgtcactgtggccactattttgttgtggtgtgtggaaagccagattgaaggtgcttttgggtcatcaggtcaaattgcaatcattcccatcgttttgttttttggtaccggattactatcaacacaagatttaaatgcctttccgtggtcaatcgttattttggcaatgggaggtattgctttggggaaggccgtctcatcctcgggtttgctatcaaccattgcaaaagcattacaaaagaaaattgagaatgatggtgtttttgccattctatgtattttcggtatcctgatgttggttgtgggtactttcgtctcgcatacagtatccgctattatcatcattcccttggtgcaagaagttggtgacaagcttggcaaccccaaagctgctcctatccttgttttcggttgtgcattattgtcatcctgtggtatgggactagcttcttcggggttccccaatgtcactgccatctctaaagtagatagaaagggcgatcgctatttaagtgtcatgactttcttaacgagaggtgttccagcttctattttggctttcctatgtgtcattactctaggttatggtatcatggcatctgttgtcaagggtaacgcaacctctgcgtaa

SEQ ID NO: 367 - DNA, 1149 bp, Saccharomyces cerevisiae
atgaataataacagcagaaacaacgaaaatcgaagcactattaacagaaataaaaggcaactacaacaagcaaaagaaaaaaatgaaaatattcatatccccaggtatattagaaatcaaccatggtactataaggatacccccaaagaacaagaagggaagaagcccggcaatgatgatacgagcactgcagaaggaggagaaaaaagcgactacttggtgcatcataggcaaaaagcaaaagggggtgctttagatattgacaataattcagaaccaaaaattggtatgggtataaaggatgagttcaaactaatcagaccccagaagatgtccgtccgagattctcattcgctgtcattttgtaggaattgtggggaagcagggcataaggagaaagactgcatggaaaaacctcgtaagatgcagaagcttgttcccgatttaaattcacaaaaaaataatggcacagttttagtacgagctactgatgatgactgggactccagaaaagatagatggtacggttactcagggaaagaatacaatgaactgataagtaagtgggagcgtgataaaagaaataaaataaaaggaaaagacaaatcccaaactgatgaaacactatgggatacagatgaagagatagaactaatgaagttagaactttacaaggattccgtaggttcattgaagaaagatgatgctgataattctcagttgtataggacatcaacgagattgagagaagataaggctgcttacttgaacgacataaattcaacggagagtaattatgatcctaaatcaagattgtacaaaactgaaacactgggcgcagttgatgaaaaatcaaaaatgttccgcagacatttgacaggtgaaggcctaaaattaaacgaattgaaccagtttgctagatctcacgctaaggaaatgggtatacgtgatgaaattgaggataaggaaaaagtacaacatgttttagtcgccaatcctactaaatatgaatatctgaagaaaaaacgggaacaagaagaaaccaagcagcccaagattgtcagcattggagatctggaagctaggaaagtagatggtacaaagcaatctgaggaacaacggaaccacttaaaagatttatatggttaa

SEQ ID NO: 368 - DNA, 3147 bp, Saccharomyces cerevisiae
atggatattacagaattgttacagtgctttgcctgtactttggaccataacgctgccgtaagaactaatgcagaaacacatcttaaaaatgcaagtaaagtaccgggattcttaggcgcatgcctggatatcattgctgctgatgaagtaccagaaaacatcaaattatcagcttccttatatttcaagaataagattacatacggatggtctgctggtgcaagacagggttcaaatgaattattagattcacatgttgatccggatgaaaaaccagtagtaaaagatatgttaattaaaacaatggtcagtgtgtccaagacctccccgcgttgtatcagagtgctaaaatctgcccttactgtaattatttcagaagattaccctagcaaaaaatggggcaatttgttaccaaattccttagaattactcgcaaatgaagacatcacagtaacatatgtcggacttctgtgtcttgctgagatttttaggacctataggtggaagaataatgatgaaagacaggacttagaagagttgattttaaattatttccctgctttattaaactatggcgcaaatgtccttttccaagatggtaaatatatgaataacgagcaaattggcgaattggtaaaattaatcattaaaatttataagttcgtttcataccatgacctaccatttacattacaacgctcagaatcgtttaccccatgggcatgtttttttgtcagcatcattcagcagccattgcctcaggaagttttgtctatatcagatattgaggtcagaagtaaaaatccatgggtcaaatgtaagaaatgggctcttgcaaacctttatagacttttccagagatacgcatcaacgtcattaacaaggaagtttcagtacgatgagtttaaacagatgtactgtgaagagtttttgactcagtttttgcaagtcgtcttcgatcaaatcgagaaatggggaactggacagttgtggttaagtgacgaatgcttatactacatattgaactttgttgagcagtgtgttgtgcagaaaacaacttggaaacttgttgggccccactacaatgtaatacttcaacatgtcattttcccactactaaagcccactgcagagactttggaggcctttgacaatgaccctcaagaatatatcaaccggaatatggacttttgggatgtcggctattccccagatcttgccgcactggctttgctaacgacatgcgtgacgaaacgcggtaaaacgaccttacaaccgaccttagaatttatggtctcaaccttacaaagtgccgttggtgattacaacaatattatgttggataatgccttgcaaattgagtcctgtttgagaatattctccagcattattgaccgtttgataactaaagattctccatttgccagtgagatggaaaagtttatattgacatacgttttacctttttttaagtctcagtatgggtttctgcaaagtcgtgtttgcgatatttgttcgaagttgggttctatggatttcaaagacccggtaataacctctactatctacgaaggtgttatgaattgtctgaataactcttctaattctttacctgtagaattgacagctgcattggcattgcaaacttttatcagtgatgaccagtttaatatgaagttatccgaacacgttgttcctactatgcagaaattactaagtttgtctaatgattttgaatctgatgtcatttcaggcgttatgcaagattttgtggagcagtttgctgagcaattacaaccttttggtgttgaattaatgaacactttggtccaacagtttttgaaattagctattgatctgcatgaaacatccaatttggatccagattccttcacgaacgttgatagcatacccgatgaatctgacaagcaaatggcggcgctaggtattttgtcgactacgatatctattctgttgtcttttgagaattcacctgaaattttaaaaaacttggaacagtcattttatccagctgcagagtttattttgaaaaacgacatcgaagatttctatcgcgaatgttgcgaatttgtagagaactctacattcctactaagagatatcacacccatcagctggaaaattttggagctgattggagaatgtaatagaaaaccagatagtatggtatcttattatttaagtgatttcatgctagccttaaataatatcctcatttatggaaggaacgaattaaagaagaacgagttttacacaaaaatcatattcgaaatatatcaaaaggctgttactgcagaagataattcgttagacgatcttagagtggtttttgatttatcccaagagttggttcttgcattagatgacagtttacctcaacaatacagagagcgcctactggcggatgttgtcggctctattctaacgcaaaagaatgaattgaaaactaatgttgtatttagtgtgactgcttttaatgtcgtaatctcaaatatgataacagagcctttgatcacgcttcagtacctgaaacagcaaggttgtcttgaaatcttctttcaaacgtggattacagactatattccgaattataaaaggtgctatgatatcaaattatcagttcttgcgttattaaaaattatactgaagttagaaagcaacgattattcagtgttgaacttagaaaatttggttccgcaattagggagtattgttacgcagttagcttcgaggctaccaacggcgttaaggcaattagctaaccaacgcaaggaattctcatcatccggttttgaagaggatactaagtgggatgaaaattttcttgacgttggagacgatgatgaaaatgatgacgagggagaccttactgagaaatatctggaactgataaaaaatagagccgattccttggacttcgtagatggttatgacgcaaaggaaactttcgatgacctagaagaggacccattaacggggtcgatcctggacacagttgacgtatacaaggttttcaaggagtccattgcgaacttacaacatgttgacagcaatagatatcagggaatcttgagacatctgaccccggctgatcaagaactattcatgggaattatgaatgcctaa

SEQ ID NO: 369 - DNA, 2205 bp, Saccharomyces cerevisiae
atgagtgctagtgaagcaggtgtcactgagcaagtcaaaaagctgtctgtcaaggatagtagtaatgatgccgtaaaaccaaataagaaagaaaacaaaaaatccaagcaacagtccttgtacttggatcctgaaccaactttcatcgaggaaagaattgaaatgtttgacagattacaaaaggaatacaatgataaagttgcttctatgccacgtgttccattgaagattgtcttgaaggatggagccgttaaggaagccacttcttgggaaaccactccgatggatattgccaaaggaatttctaaatctttagcagacaggttatgtatttctaaggttaatggtcaattatgggacttagatagaccatttgaaggcgaagccaacgaagaaatcaaattagaactgctagatttcgaatctgacgaaggtaagaaggtcttttggcattcgtctgcccacgtcttgggtgaatcttgtgagtgccacctaggtgcccatatttgtttaggtcctccaactgatgatgggttcttttatgaaatggctgttagagatagtatgaaagatatatctgaatctccagaaagaaccgtctcccaagctgatttcccaggattggaaggcgttgccaagaatgttatcaagcaaaagcaaaaatttgaaagattggtcatgtccaaagaagatcttttgaaaatgtttcattattcgaagtataagacttacttggtacagacaaaggttccagatggaggtgctactaccgtctaccgttgcggtaaattgattgatctatgtgtcggccctcatatcccacatactgggcgtatcaaagctttcaaactattaaagaactcttcttgttatttcttaggtgatgcgacaaacgactctttacaaagagtttacggtatctcttttccagacaaaaaattaatggatgctcatttgaagttcttggcggaagcctctatgagagatcacagaaagattggtaaagaacaagaattattcttattcaatgaaatgtccccaggttcttgcttttggttacctcatggtactagaatttacaacactttggttgacttgttgagaaccgaataccgtaagagaggttacgaagaagtcatcactccaaacatgtacaactccaaattgtgggaaacctcaggtcactgggccaattacaaggaaaacatgtttactttcgaagtagagaaggaaactttcggtctaaaaccaatgaactgtccaggtcattgtttgatgttcaagtctagagaacgttcttatagagaattgccatggagagttgcagacttcggtgttatccacagaaatgaattttctggtgccttgtctggtttgactcgtgtcagaagattccaacaagatgatgctcatatcttctgtacccatgaccaaattgagtctgaaattgaaaatattttcaactttttgcaatacatttacggcgtttttggatttgaatttaagatggaattgtccactagaccagaaaagtacgttggaaagatcgaaacctgggatgccgctgaatcaaaattagaatctgccttaaagaaatggggtggtaactgggagatcaatgctggtgatggtgctttctacggtccaaagattgacattatgatttctgacgctttaagaagatggcatcaatgtgccaccatccaattagatttccaattgccaaacaggttcgaattggaatttaaatctaaagatcaagatagcgagagttacgaaagaccggtcatgatccatcgtgccattttagggtctgttgaaagaatgactgccattttgaccgagcattttgctggtaaatggccattttggttatcaccacgtcaagttttggttgtgccagttggtgtcaagtaccaagggtatgctgaagacgtccgtaacaaattgcacgatgctggcttctatgccgatgtcgatttgaccggtaacactctgcaaaagaaggtcagaaacgggcaaatgctaaaatataacttcatttttattgttggtgaacaagaaatgaatgaaaaatctgttaacattagaaacagagacgttatggaacaacagggtaaaaatgctactgtttctgttgaagaagttttgaaacagttgcgtaacttgaaagatgaaaagagaggtgacaacgtcttagcttaa

SEQ ID NO: 370 - DNA, 2007 bp, Saccharomyces cerevisiae
atggaaacatgggaagtcatagcatcggtaaaagaagcaacaaaaggccttgacttgagcttagatcatccacttattattaaatccgaggacgtgcccagtaacattctccaattactgcaacagaagaatcgacgtcaattgaaacacatctgcatgaaatcaagaaaagagtattttctactagaggaatatgggccaggattttgggttaagtggccgtacaattatttcaatggttacagcttaccagaaaggcgtacggaagttgtaacgacagttgaaagagaaagagctaagcgtgaaacgttaaaaacatgggacgaattgaaatttaaagagcttcttcatttatggtcagaagaacccaagggctcgtgtaagcttgagaaggacaaagaccttaaactggatatgaatcccccagatatgaaaggcgaatcaaaaattaatgactactattcagaccctaaagagtacatagaaagtaagtattatgatgctcttttttccatacatacgcctctcgcatatttcgtcaagtcaaatttagtaaggctcaaaaatacctgccgaaccaagtacggaagtgacagttacaaaatagcctatcaagccatgctgcaaaaatttcttctctcaattgtacaattcaaagatagacatgataacaggcttttattagagcccttttctagtcccatagcagatgaaaaaaggaagaactgtctcacaaaatttgttatccaagatgaaaacaaaaacagctcaaccattgctgatttatgtgttgtattaaaatcccgcgaaataaagctacaaatattattgctattagagataataggattgaacgatttagattggaattttagagattttgagaaaaagtataaattaaaattgaagaaaagatcacttaatttgacaaaaaagggattagttcgtcgaagatcgaagaaaaaaaccagcgaaaaagacaaaggaatcgagagaataacaacatctttggattattgtgaacagttagacttgtacttagatagagcatgcatcttggacattctactatcaagtgaaacgcccaacccagatgccatagaagcatcaaatggaacaatacaagagcataaaaaaaatatcctagacaaaagcaaagaagcctcattggttgggttcataaattatgttcttattccatatttcaacaaaaaggtaccacacgccgttgaatttataattcaaaagctcaagggaccaagcatgagaccaaagagagccctgaaaaaggtcaacgatagcacaaatgtatcgtcacctaatactgtagaaacgtataacaggttatccacgagtcaacgtgcctctcgctcttcaatcattaattccgtcccatcttcacccgcattgagaagggtggacgctaatttgttcagcagaaaatctatagcttcgcccacccctgaacttttgaattctagaacgaactctaacttgaatgaatttctcgaaagtgaaactagaagcttaaagcgcccttcacaattgggaaggacgaagtctgatctaacgatgaatcatttacaaaaacggcagttttctgtctctgacttaagcacaacaagagtaccgaattcatcaactatcacactcaaaacgcctttctcgcactcaactattaatgcatacaaaactatgaataactcttttcgcagagttgggaaacgtaaagatatcaatgaaacgatacgcctacatgaacgtgtagactctgaggaaaacgtacaagttcaagccactcctgctgtgaaaaaaagaactgtgacacctaataaaaaggcgcaacttcaaagcatcattgaatcgccgctaaatttcaaggatgatgatacgcatgaaggcagaaaaaatacctccaatattacctctactcccactaataagcccccggaaaatagctcaaaaaggagagtaagaagacgtttatttgctccagaatccacatag

SEQ ID NO: 371 - DNA, 2883 bp, Saccharomyces cerevisiae
atgtttagaagaagaacaactgcaccagaaatggaacaggcggacccgacagcagtggcagctgcagcaagtatcggtaaattattaatgaagaagggtaatcaatctgataacgaacaaaggccgacctatcgatccgcttcgatgacaaacttaagaaaaccttctgcccccaaaagaatgtcttctatttctagtatatcatcggaatctagaaggagcgatggtaaaggtcgtcccgggaaaataaacagccttacccaacggtcatcaatggggaagggagattcattaaattctcctttaacgaaggaaccgcagcacaaaactaggtctcacaatagaacttcgagtctccctaaccagagaggtcagcaaagcagaaacagttctggtttacaacgtcaaaagtccaaaacacaccaaagaataagctatgatgaggctcaacgtacgttcaaggattttggcggaccacaggccagaggaattttaacgggacaacaccgtactgaaaatcctagcgggtctattcctttgaggactacgcgaaagtatattcctgggcccaacgggctggttgcaattgaggtccccgttgaaaaaccaagcaatgccaatacttctaaattgctaaggcgttccaactctgcccacagtgccttgaatgcaagaaatggttcacttttaagaaaaaaagtatcgcaggaatctttacattctcaaccaaagaagacttcgtctttagggaatacatcaagtacacaagcaaaaaaaggccaaaaggcggttcaggagagaaatcttgccaagaaacatccaataaattcaaatgttcctctcattgaaacacaagttcgtgaagaaacagaccaagagttgaaacttgataattctaactcttccgaatccgaaacagtagtcaatagcgaaaataatctagaaaaaccttcttcactaaacattgaaaaagatgatctaagcaaactaatacatgaaaacattgagttagaaagttttattgaagaaaaagggaaggaaaaacctttaaattctgatcaagaagatgttttcataagcgaaaaaactgtaaaaggcgatgtacaatggccaaaaaataaccgtcaagcatctactcttgagaaaacttttaattacgacaacgaagagaagagggaggggaataaaccagtagcagaacatcctcttccggaggccgaagtggatgacaagtcggttgaacaactgaacaacatttcttctagcggcagttattcggcccaaggatcagttgaaaactccaaaccagaaaatggcaataaaaatctagagaatgacacaacatcgtctcccacacaagaccttgatgaaaaatcccgctcaatagaagagaaggataccttggaagggaccgagagttcaaaaaaagttgaaaagccagacaattgttgtgagaaaatttctggtgctaatacttcttccaaaaaagggaatgttggcgatactaaggatgaattcttcgatacagtagaagaaagcgatcagaaaacgagcaagtcgaattcctccaagaacaccgatcattctaatcaaacagaaccaacgccttctttggctcagtatttaaggacctcaaatacctacctttctcgaaaaaaccaatcgaaacaagctgagcaagaaaagtttcacaagcctgaagctcctatggttcctgtaacgaaagtagttacaccaatcaaatctgctcttaaaaaatcgtcaggatcgtccaaccatgactcatccatgtactctgataactctcccgccaatggcgcatacctgtctcttacgactgctgaaaatacgagattaaatgctcaaatgacgatgtccgacagcgtatcacgcagagcaagtttaaaacgatcttctataaaaagacctcagtcagtaggccagttcagaagcatcagatcaaattcgccttctcccccagagaaaataaacaataaacgccattctgctatacccctaggaaccccagagaagggtaaaccaaaaagaaattcggttatggcttctctgtctaaaaattcgcagcaaattcaagagcccgcaagtgtatatgagtcaaatggcccaaataaacctaaaaaccaaatcaataagaatataaagagaggatcacagatcgcgcaaaacaataaaccttcaacgaaggacatgaatagtattttgtaccccaaagaaccacctcctcgcaaatctagttttgagaagacgagaagcaatgaatcccatctcggatttaaaaagctttctttgagaaatggtaattttgaggaggcattgagtgaaagctataatgggcaagctagccagaatagcacaaatgtgaatcgaaccgatacagcacaggagtttttcaaatatttgggtcattcatcaagatttgcggattcagactcagaagatgagtcccaatttttcaaccaaggcccatcaaaatacaacacagaaacagaaggcaataaaaccagcggtaacaaaaatagtaatggtggtaacggtgctttttcgcttttcaagagcaaaagtaagcaaaaggaaaataatgtggtttcccctggagtctcaagtcctaatcatactaccaccgatcctgccattacaagtaaaaaggtggacaagaaattcagcgggttatctttaagagctgccagtgaagctgaacctgcaaaaaattcaaacccttcgatgaccaataggttacgcttctctagtaatccagagaacggcgaaagcaggctcccacaagcacaggaagtcagcgttacaaaagaaaagaagggtagtttcggcaaaaaactgaaaaaaatctttggtagaaagaaatag

SEQ ID NO: 372 - DNA, 2733 bp, Saccharomyces cerevisiae
atggaccaagaaggccagccattgctttcaaaagattttcagcaggttttactggctactgcatccggaaacaattcatcgtggacagaaagggctgttctcaacaatgaaagtacagatgcagtgaaacacgaacctgcgctgggccaaaatgatgtgtttgatttagatcctttatcctttgataagtgggtaccttttttaagaagggctcttgataaaaatcaattggaccccgtaattgatgaattggaaaattcaattgaggataactttcaaggtctggaattgcaattattacaagattcccaaatgaatgataagctggaaacatctatagacgaaattgcaaacatccaaggtatggtgcaagacactttatccagtgaaatttccaaatttcaaataagattgagtgaatcagctaatgaactaattgtcaagaaacaaatgtatgttaataacaaaaaaatttcactaaaaatttcagaagcaacaattttaatcactaaggttgttagaatcttggaattatccagcaaatgtcaagaattgatcaccgaaagaaagtttttcaaagttttacaaaacttggatagtctggagaaattgtatctacaagaatttaagaattataatttccaatttttaattgaaatttacaattctataccatttttacagaaagtcaccaaggatgagtgtataaatttgataaggaattctctaaatttaaatttagggaagaacttgataaaagtggggcaagaattcgtggcaatttatgagaatgaattacttccgcaatggctcgaaacgagatctaaaatgaagttgacaaatttcaaatttaattcgcctatagagatctccatgagagatgaatcctttctagcaaagctaaacttgggtgaatttttccagttagatgactttcacgattctataatgatttttcaaaacttaaatgagttgagcgtcctctctggagagtttaacaaagaatatgaactgagaaagacaaaactaatgtatccattgatatggaagaagaataaaacagctgcatatcaaatggattcgttattacggggtacaggtactactcctggatcaaccgcgcatgacgtttccacagatgatcctttcacacaaagtctaagtttacactttttgcaggattactttttgaaaattctcggcttcttattatatgatattaatttgaataaagctacagaatttatcctcgttgataataactataattctacaaatgaattttgggatggactcatggacaggttgtcaccatatttgagttatttcatagatgagaagctgaaaacagaagaagacatgattaaattgaaagattttctttgtatttatgttgccattttagaaaatttcaaactgaacatcgaacctttatataaaattttggtttcaattttcgagaaattctgctctgtttccttgagagcttttgacgatgaatttcaaatcttgttaaacgatgatgattttatgcctttatccattaatgacaagacattatatgagaaagttttgaagatttgctggatgaaggagggcgaacacctttccctgccagatccaaccaacggagagccatttgctgtgactttgcctttttctccattatacccaatgacgtgtacacttgctaagaaaacatattctaaaataaccgcatttctttccatattttatcgtcatgagctacacactttgaataatattttggtcaaaacaatggacgatatatttaatgatatcgtcaataaaaaaattcgttctaaacttgaaagtacgtcgagagaagaaattgcacaaatcttagtcaatttagattattttatcatagcagcaaaagaatttagtaacttcatgacaagagagaatattttacaaaacccggatatggaaatacggttatcctcgataaaatatcttgcggaaagcagaaaattggcagaaacaaagttaattgaattaatcgattctaagatatcagatattcttgaaactattgaaattgactggcaaataacggaggtaaggcaagacccggatatctccatcattgatctggcacaatttttagaaatgatgtttgccagcacgctacaaaatttaccatacagcgtccaaacattattgattttccgtgaatttgactccttgacgagacaattcatgggtctattattgcatgacacaccaagtacaattacacatgaaagcataatgaattttgaagttgatgtcaattatttagagagcattattcccagaattttcccctctacaccaggtactatagatagtaatggataccagtcgccaatgaccccttcgacgcctacatttccaaatgccaacggtgttgacgcaccaacattatttgaaaataatatcaaatcgctagaagctacatttatggagttgaagcagtgtatagagttattaaagactcagggaaaagattataatgaaccagaaataagattaagaaaatattcaagaattagacaggaagatgcggctcttttgttgagcaagattcagcacttcgtctcatctgtagaaggagctaacggcgatgacactagcgtaatggatagtagcagcatattcaactctgaatcagcgagtgtcattgactctaatacgagtaggatagccaaattttttaatagacgttaa

SEQ ID NO: 373 - DNA, 2058 bp, Saccharomyces cerevisiae
atgtctctgacaccaactaatgaaatattgtttcattacaagtcttcagtgaaggttggtgaacttgagagatatgtaattacttatcatctttatgacggtgaggaaattccaccagatttgaatttaaattccttgtggttaaaggtgagaaatatgaatccgttatcgtatagagctgcgtacctaatgggtccattcatgctttattgcgatgtaaaaactgcccaatatcatcattcccaaaaaatagttgcttcagttgattaccccaaatttgaaccgaatgtgcaaactcaacaagatttcgtggctgaactttcagtacataacatacgacagaaatacgtatggattgctgatgtgatgagtcaaatattgttcactacaaatacgaacgtcacttacgaagtcactattggaactagtaaagagtcagtagaaaatccgcatgatctgccatctcatctaggttcttatagccctaaacttacagtgaacaggttaactaccttggatttgtggaatcttcccgttcagattaccacaccacagaaaaagaaacatcttgtagttttgacacatggtttacattctaatgtgtcgaccgatctagtgtatattatggaacagatatacaaagcacaaaagaattatccccacgaacaaattgttgtgaaaggttataggggaaatgtctgtcaaactgagaagggagttaagtatttaggtactcgtttggccgaatatattatccaggatttgtacgatgaatccatccgcaagatttcttttgtaggtcattcattgggtggcctaatccaggctttcgcaatagcgtacatttatgaagtctacccttggttttttaaaaaggtgaatccaataaattttattactttagcttcaccgcttttaggtatagtcacagataatcccgcctatattaaagtactactttcattcggggttattggaaaaacaggtcaagacttgggtttggaaaatgatgttgaagtaggcaaaccgcttctctacttgctatctggtctgcccttgatagagattttgcgtaggttcaaaaggaggacagtatatgcgaacgctattaatgacggaattgtcccattgtataccgcatcgctattgttcctagactataatgatatcttggagcaattacagaaactaaaggagaacagcaaaaaatcaccgctaataaatgatgcttcaacacctgtgaatcaagatttcttcaataaaactttcatttcgcctctgactaaaatgttgagtatactggcgccacaaaagtttcctacggagaatggttccgaaattcctaaagtatcatttttcgagtcagcaagctcaattctccttcctcctttacctgaaagagcgtacataatggatccagattcaagagatcctgtaattattcatgataagatatacaatgaggatgacattccacaatccgaatttgatatcgaagacggtttttttggtaaaaagaatatactccttcaggctttttttgcaggaaagaaagaacgtgcgaagtatcgaaatttggaagaaacgattgctcgaaggtggcatgaaggaatggcatggagaaaggttgtcgttgctttaaaacctgacgctcacaacaacattatagtccgaagaaagtttgccaacgcatacggttggcccgttatcgatcatctgatagatgtccacttcaatggtgatgacgatgacgataacgatgaaaatgacgatatcaattccacacaagttgttgaacctattcagagcgtaaccgaaggaaagaaaaagtataggaaagctgaaaacattcctcaagaatatggatggttgaataaggttgaaacaaacggagtctttgacgaaggtcctacgggaatgatatcaactgttggtgaaatagtcgaggcgttagctaaaagaggatttagcgccgtaatcgacaggagaaatgcctcggaagatccgaatgatgaggtccttcggtttgaagaaatgaatagtgatttggtacaatga

SEQ ID NO: 374 - DNA, 1869 bp, Saccharomyces cerevisiae
atgagattacattatagaagaagatttaattttttaaggagaatactttttatattatgcattacttcattgtatttatcgagagattcactaaagctacatgcaaaaaatgtattaatggatcataatgtagcagaatatcatggcggaatgatagacgatattcaaatcctgcggtgctaccattggtacaggcaatgtagttctttgtatgccccgaaattacacccctccaatactgctaaaaagatcaaagacaaaaacagcattctgtggaccagagtttctaagaatattactgtagagacattgtattcacttcagtctggaccattctacaacagttacttatatgttcatctgaaagatttccaaagtaatccaaaaaacacaataaaagaactagccatagcaagggactcagcactaatacccctacaagtgctgagagacattaataagttggtgaaatcgagcgacagttctgtctttcacaatcatgtgtatctacgagaaaagcctacttcgtcatggtggaagctgcttttcggcatatccgttgatacagataacatagctgtgttcggtgaggagtgggtatacaaggggagcggcatatggtgtaagtatatccttaatgatgatgataatgacgctcctataactaatttggaaatatatctaggatcatcgtttattgaatcgaggccttcttggaaagaagttatccatgaatttcatagaaataacataccttctctgcccatatcaattacaagaaagcttgaaaccaaaaaccatcatcacaaattttctaatggattgctaggttctttgagaacacccagcaaagacattaatatccaagtcgatgcagattacaaaataacatctccccatatacaattttcgaggggacaaagatcattcaaaattctccaaataactgattttcatttcaaatgtacggataatagcatgaccgtaatcaatgaaataaaaacagtaaattttattgatagggtactcgcatcagaaaaccctgatttagttgtgatcacaggtgatttgttagactcacataatactatcgactatcaaacgtgcattatgaaagttgtccaaccaatgatttctaataaaataccctacgcaatttcattgggtgtttctgacgaatccaatttggccacatcggcacaaattagagactttatcaggaatttaccttacacatttaacaacgttgcatcagaagagggtcatatggccatagaagtctcatttaaaaagaagctcacgaagaatactcttttggaaagagacattgataccgaagacgaaacaaacccatcagaggctttatttttcgtctttgattcatttgcgcccgtcaataatttcctacaagattataacgacctgattgggaaaatagactttggcttggcatttcaatattttccattatcggaatataggcctcatggtttatttcctattattgggcagtataatgagaggtctaccttaacagtagatacgccaaggtctagaggacaagtttcaatgacgatcaatggcaaacattacaaaagcttccttgatatcctgagtctttggaatataaagggtgtcagttgcggacatgaacataataatgactgttgcttacagtcaaaaaatgagatgtggttatgttacggtgggtccgctggtataggcttgccgagaatccaaggtatatatccaaccgttagattatttaacttggatgatattttggacgaaataacttcgtggaagaggaatagcaatcttgttgacgaggtttacgattatcagtacatctataaggggaagcaataa

SEQ ID NO: 375 - DNA, 2289 bp, Saccharomyces cerevisiae
atgtctgtgcccaaaaaacgtaaccatgggaagttaccaccttccactaaggacgtagacgatccttcgttgaagtacacgaaggccgcgcctaaatgtgaacaagttgctgaacattggctcttgcagccactaccggaaccggaatcacgttatagcttttgggtaacaattgttaccttattagcgtttgctgctagattttataagatctggtatccaaaagaagttgtttttgatgaggtacatttcgggaaatttgcatcgtattacttagaaaggtcttatttctttgacgttcatcccccttttgctaagatgatgattgccttcattggttggttatgtggctatgatggttcctttaagtttgatgagattgggtattcttatgaaactcatccagctccatatatcgcgtaccgttctttcaacgcgatattgggcacattgactgtaccaattatgttcaacactttgaaggaactgaatttcagggctattacatgtgcgtttgcatctctcttggttgcaatcgatactgcgcatgttacagaaactaggctgattttactggatgccatcttgattatttctattgctgctactatgtattgttacgttcgtttctacaagtgccaattgcgtcaaccttttacatggagttggtatatttggttacacgctactggtttgtctttatccttcgtgatttccacaaaatatgttggtgttatgacatattccgctattggttttgctgctgtggtcaacttatggcaattactggacatcaaggcgggtttgtccttgaggcagttcatgagacattttagtaaaaggctgaatggtttagttttgattccatttgtgatttacttgttttggttctgggttcatttcaccgttttgaatacttcaggtcctggcgacgcatttatgtctgctgaatttcaagaaacacttaaggactctcccttaagtgttgactctaaaaccgtcaattattttgatattatcactatcaaacatcaagatactgacgcattcttacattctcacttggcacgttacccacaacggtatgaagatggtcgtatctcatccgctggtcaacaagttactggttacacgcatcctgacttcaacaatcaatgggaagtgttaccaccccatggcagtgatgtcggtaaaggacaagctgttctattgaaccagcatataagattgagacatgtagccaccgatacctacttgttagcccatgatgtcgcctccccattttaccctaccaatgaagaaatcactacagtaactttagaagaaggtgatggggaattatatcctgaaacactttttgcattccaaccactgaaaaaatcagatgaaggtcacgttttaaagagtaaaacggtttctttccgtcttttccacgttgatacctccgtagctttgtggactcacaacgacgagttgttaccggattgggggttccaacaacaagaaattaatggtaacaaaaaagttattgatccttcaaataactgggttgttgatgaaattgttaacctggacgaggttcggaaggtatatattccgaaggttgttaagccattaccattcttgaagaaatggattgaaactcaaaaatctatgttcgaacataacaataaactatcatcagagcatccatttgcctctgaaccttacagttggcccggtagtttaagtggtgtttcgttctggaccaacggtgacgaaaagaagcaaatatatttcattggtaacatcattgggtggtggttccaagtcatatcattggctgtttttgttggcattatcgtggccgatttaattactagacatcgtggctattatgccctaaacaagatgaccagagaaaagctgtatggcccattgatgtttttcttcgtctcctggtgctgtcattattttccattctttttaatggcgcgtcaaaagtttttgcatcattacttaccagctcatttaatcgcgtgcttattctcaggagcactatgggaagtaattttcagtgattgcaaatcattggatttggagaaagacgaggatatttcaggtgcatcatatgaacggaaccctaaggtctacgttaaaccctataccgtcttcttggtgtgtgtctcctgtgctgttgcgtggttttttgtatacttttcaccactagtgtatggagatgtcagcttgtcaccatcggaagttgtttctagagagtggtttgacatagaattaaatttctccaagtaa

SEQ ID NO: 376 - DNA, 2718 bp, Saccharomyces cerevisiae
atgaataatcagccgcagggtaccaacagcgttccaaatagtattggaaatatatttagcaacattggaactccatcttttaacatggcgcaaattccgcaacagctgtatcagagcctcacaccacaacaattgcagatgattcagcaacgacaccaacagttactgaggagtcgtctacaacaacaacaacaacaacaacaacaaacttcaccgccaccgcaaacgcatcaatctccaccccctcctccgcaacaatctcaacccattgctaatcaatcagcgacttctacccctcctcctcctccagcaccacacaacttacatccccaaattggtcaagtgcccttagctccagcgcctattaatttgcctccacaaattgctcagttacctttggctacacagcaacaagttttgaacaagttgaggcagcaggccatagcaaaaaataatccacaggttgtgaatgcaattactgttgcacaacaacaagtgcaacgccaaattgagcagcaaaagggacagcaaacggcacaaactcagctagaacagcagaggcaattgctggttcagcagcaacagcagcagcaacttagaaaccaaatacagcgacaacagcaacaacagtttaggcatcatgtgcaaatacaacagcagcaacaaaagcaacaacaacagcagcagcagcatcagcaacaacaacaacaacaacagcaacagcagcaacagcaacagcaacagcagcagcaacaacaacagcaacaacaacaacaacagcagcagcagcagcagcagcagcaaggacaaataccgcaatctcagcaagttcctcaagttagatccatgagtggacaacctcccaccaatgttcagcccactattggccaacttcctcaacttccaaaattaaacttacccaagtaccaaactattcaatacgatccaccagaaaccaagctaccatatccaacctattggtcagacaaaaaagcagatacggatactttgttgtacgaacaaattatccagcgtgataaaattaacaaatattcgctaataagagaaaccaatggttacgatccgtttagcatttatggatttagtaataaagagtatattagtagactgtggcatacactgaagtattatcaagatttgaagaacactagaatgaaatctatcacaagcacttctcagaagattccttcggcaagtatttggggaaatggttactcagggtatggtaatgggattacgaatacaactaccagagttattccacaagtagaagttggaaataggaagcattacctagaggataaattaaaagtctataaacaggccatgaatgagacatcggaacagttagttcccataagattggagttcgatcaagatcgtgacagattcttcctcagggacactttgttatggaacaaaaatgacaagcttattaaaattgaagactttgtggacgacatgttgcgagattaccgatttgaggacgctacgagagagcaacacattgatactatttgtcaatctatacaagagcagattcaggagtttcaaggaaatccatatatagagttgaatcaggaccgtctaggcggtgatgacttgagaattagaatcaagctggatattgtcgtgggacaaaaccagttaatcgatcaatttgagtgggagatctctaatagtgataactgtccagaagagtttgcagagtccatgtgtcaagaattagaactaccaggtgagtttgtgactgccattgctcactccataagagagcaagttcatatgtatcataaatcactggcactgttaggttacaattttgatggatcagcgatagaagatgatgacattagaagcagaatgctcccaacgattactcttgatgatgtttataggcctgcagcggaaagcaaaatttttactccaaacctattacagatttcagctgcagagttagagagattggataaagataaggacagagacacaagaaggaaaagaagacaaggtagatctaatagacgtggtatgctcgcattgtccggcacatctgcaagtaatacatctatgaacggcgttcacaacacagtagcagcaggaaatgcttcatcgttgccaccaggagagattttactgccagatattgcagatattccaagaactttcaggactccagtacctagcactttaatgcctggtggtgttgacgtaggcccttctgtggaatcgtacgaattgagaaacacaaccacttataaaagcaggccagatagacctaagccagtttcacctccttgttatattattgaccatattccgggtcattcgctactactttctattaaactgcctgggaaagttaatacaaaagaagagttcgcagcagcgcccaatgacacaagtagtggcaccaatgcaatgcttccgagtccagaatcgctgaaaactaagctgaatagtaacattcgcgctggtgtgacgataccttcaatcccaaacccgattgccaatcacactgttactaattcacccaatcccacactgcagccagtaatcccaggtggggcagctagtaaatcggtacctacacctagtcttcctatagcacctccagtagcaccacatgatagcgaagcgacattgttgactaatagcaataatggtagcagtaacaataacacacagaatacatag

SEQ ID NO: 377 - DNA, 1476 bp, Saccharomyces cerevisiae
atgagtgctctactgtccgagtctgacctaaacgattttatcagtcccgcccttgcgtgcgtcaaacctacccaggtgagcgggggcaagaaggataacgttaacatgaacggagaatacgaggtgagcacggaaccagaccaactggagaaggtctctattaccctatcagactgcctcgcgtgttctggttgtataacgtctagtgaagaaatcttgttgagtagccaaagtcactcggttttcctgaaaaactgggggaagctttcgcagcagcaagacaaattcctcgttgtgagtgtctcgccacaatgcagactatctcttgcgcagtactacggcttaacattggaggcggccgatttgtgtttgatgaattttttccaaaagcatttccagtgcaagtatatggttggaacggagatgggcagaatcatatcgattagcaaaaccgtagagaagatcattgcgcataagaaacaaaaagaaaataccggtgcggaccgcaagcctctattatctgctgtgtgtccgggatttcttatatacacggaaaagaccaaaccgcagttggtgcctatgctgctcaatgtcaagtcgcctcagcaaattacgggctcgttgatcagagctacgttcgagagtctcgctatcgcgcgtgagtccttttaccatctgtcgctgatgccatgttttgacaagaaactagaagcgtcaaggccagaatcgcttgacgatgggattgactgtgtcattacgccacgtgaaatagtgacaatgttacaagagttgaatttagacttcaagtcgtttcttactgaggacacaagtttatatgggcggctatcaccgccgggatgggacccgcgagtccactgggcgtcgaatctgggaggcacttgtggtggctatgcctaccagtacgtaacggctgtccaacgactacacccaggaagtcagatgatagttctggagggtagaaacagcgacattgtcgagtaccgattgctgcacgatgatcgcataatagccgccgccagcgagctttccgggtttagaaacatccaaaatctggtgcgtaaactgacctcgggctccgggtcagagcgcaagaggaacatcaccgctctgcggaagagacgaacaggtccaaaggcgaactcacgcgagatggcggccgccacggccgccacggccgatccctaccactcggactacatcgaggtaaacgcgtgtccgggtgcatgcatgaacggtggtggcctactcaatggcgagcaaaacagtctcaagcggaagcagttggttcagacactgaataagcgtcacggagaggagctagcaatggtagatcctctaaccctgggacccaagctagaagaggcggcagcccgcccgctttcgctagagtacgtcttcgcgcccgtcaagcaggccgtcgaaaaggatctcgtctctgttgggagcacctggtaa

SEQ ID NO: 378 - DNA, 1755 bp, Saccharomyces cerevisiae
atgccagtagtcaatcatgaggatagtgaatttcacctttcgcacacagaagaggacaagttaaatgagttccaggtcatcacgaatttccccccagaagacttgccagatgtggtgagactgttgaggaaccatggttggcagttagaaccagcattgagccgatatttcgatggagagtggaaaggcgaaccagaccagatgggagagcccactcaaacgtctacacccatggctgagaccttggttcctcccgcgttgggacctagaccgttgttatttacagcctcactgcccgtggtcagaccattgccagcgaacttccgcaatgatttcagaacaattgggctaaatggacgctctaacactgtgtggtccatgtttgaatcttttagttatgatggtaacccctttctttttattttactgttgatccctcggataatcaataggttatctgccacaatattcacgttcttttgcactctattgtccctgcattcgataagtggtggcggtaattcaggaaaacccaagatctccaaggttccaaaggcaccaaccagagaaacccatatcccacttgcagaaatactgggtgacacgaaggacaaggatgcattttgcgaactaaaaagctttaaaccagacatttccttcaatgaggccttgcgtattgcaaaagaagagtttaagtttatgttgctcatcctagtgggcgacacctacgataccgatactgataccgtagatgttaattctaaactactattggaaaagattttgttaaacaagaagactttacagtacttgcgcaagattgataacgacctgattatctatttgaaatgcgtacacgagttggaaccttggctggttgctcgccaactaggtgtcagaaacaccccggagatattcctcattgccaacgtggctaataaggcttcccattcagaaactttgccctcacaaagactctccattctcggcaagctaaaggtcaattcactgaacagattcttgcagtcgttaacaaacgtggtggaaaagtacactccagaattagttgttaataaaactgaaatgcacgagctacgcatgtcaagagaaataaaaaaactgcaggaggatgcgtacaaaaagtcgctagaaatggacagaatcaaagctatagaaaaggaaaagagcttgaaacacgctcaggatttgaaattaaactcaactgctcggcaattaaaatggttaaaggcttgcatcgatgagatacagccgttcgagacaacggggaagcaagctactctgcaatttaggacttctagtggcaaaagattcgtcaagaagttcccctccatgactacactttaccaaatctaccaatccattgggtgtcacatatacctcgcggtatattctagtgaccccgcagaatggtctaacgccctccaggacaaaatcaggcaattatctgcagacgacgatatgctctgctttaaagaaggacaactcgaaactgctactgctaccactatcgaagagctcggccacatcatcaacaacgagcttacctcatttgatctcgaacgtggtaaacttgaattcgactttgaattggtatcgcccttccctaagtatactgtgcatcctaacgagcacatgtcggtggaccaagtgccccagctatggccaaatggcagtcttctagtggaagcactggatgaagaagatgaagaagatgaggaaaatgaagaacaatga

SEQ ID NO: 379 - DNA, 2205 bp, Saccharomyces cerevisiae
atgatggactcaaaaacattgacagcatcaatggtaatgcaggaggagaagaagcggcaacaacctgtgacaagaagagtaaggtcattttctgagtcctttaaaaaccttttcaggccgcctcgttcaagagattcaagtcctattaatgtcacccgaattccttatcgatcgtcttctacctcacccaagagaagctctgagccaccaagacgatcaaccgtatccgcacaaattttagatccaaaaaattctccaatacgccagcgtagttatacattgaagtgttgcaccccgggcctgtcacatccatttagacagacaggaagtggtgctagtaatagtcctaccagacatcgctctatatctggggaagaacaggaaattgttaacagtttaccagaatacaaaagatctgcttctcatacttttcatggcatacggcgtccacgttcaagaagttcatctgtttcgtcatgtgacagttcaaatggaacgacaagttcatcagacagtcaatgggctatggattctttactagatgattcagacaatgacctcacaccttatcgtggctcgaacaaagatatactgaaaagtaaagaccgggcgccgtataattacatagatgactacaataagaaggctttacgcagagcaacatcatatccaaatcctctcccctccaagcaattctataatgaaaggttatacaccaggaggtcacatccagatgaagaaagtttggagagcttgcctcgatttgcaggagcagatgtgcaatgtataattgagcaaaatggcttcaaagtttacgaagacggaagtcatgaacataatataaagttatcaggggtaattgcgaaattagagaaaggtaactccttaccggcacatcgacagggatcattatctagaccaagattaggtattactctttctggtctattcaaacatcataaaaatgaatgcgatattgaaaacgctttatctcttctgccaaacgtagaaaaatctcagacaaaccatgagaaaagaaccggtcaaagtcctaacgatagcaaccgcagctcgcccacgcaaggaagggaagattatctaaaaatagtgaatcccgacgcatcattgggcagtgatgagttgaagttgattaattcattatcaagcagaattcataaaagtttacaaaattatttgcaagaaaaaaatctaaaaccggctgagtgtatcggcgagcaagcacctacttttcaagataattatggccatcctgttggtctcgttggcgctggagcttacggtgaagttaagctgtgtgccagactacggaatgaaaaggactcccccccatttgaaacatatcatgatagcaaatacatatactatgctgtgaaagaattgaaacccaaaccagacagtgatttagagaagttctgtacaaagatcacctctgagtttattattgggcattccttgagccactaccacaaaaatggtaaaaaaccagcccccaatattctaaacgtatttgatattctagaagacagttcttcgtttattgaagtaatggaattttgccctgctggtgacctttatggtatgctggtcggtaagtcgaaattaaagggccgattacatccgttagaagccgattgtttcatgaagcaactgcttcatggtgttaagttcatgcatgatcatggtatcgctcattgtgatttaaaacctgaaaatattctcttttatccgcatggtctattgaaaatatgtgacttcggtacaagttctgtatttcaaaccgcttgggaaaggagggttcatgctcaaaagggtataattggatcagagccttacgtagctccagaagagtttgttgatggggagtattacgatccaagactgattgactgttggagttgtggcgttgtttatataacaatgatattggggcattatctttggaaagtagcttcgagagaaaaagatatgtcttatgatgaattttacaaggaaatgcagcgtaaaaaccagtttagggtattcgaagaattaaagcacgtaaactcagagttggccacaaatagaaaaatcgcattatatcgcatctttcaatgggaaccaagaaaaaggatttctgttggcaaacttttagatatgcagtggatgaaaagtacgaattgctgcctaatatatgattccacataa

SEQ ID NO: 380 - DNA, 3399 bp, Saccharomyces cerevisiae
atggaaaaagaatcagtatacaacttagcactaaaatgtgctgagcggcaattgacctccatggaattttcgaacctttacaaggaattctttaatgaaaagttcccgtctttgattcaagaggaagaagaagatacaacaacaactgcaaatataaatgaggtcaagaaagcgtccgatttggtggatacacccagcaacaacacggctgctactgcagatactacacacttacacgaggctctagatattgtttgctccgattttgttaaaatattaaacctggagaagcctcttatcttggcagattatatcgttgaggtattgcttgtgaactacaactcagatatgataaaatgctttctgcctaaattgaattccgttaggaactccttgctattggcccattttttctccaaatcttgttcattctttgccaaattatcagatactttgataattgatcaagtacgcaaggatttgggcaacgtcatagtaccgaatatcttaagtctagacatgaatagtatgaataaagaattgattgccatagtatcaaagcttttgcaaacaactttaaaactctctccttcaccaattcttttaacttctgccggctgtaaaaatgggtcttttacgctactaaatcagttgtctcaaaccaacaagttactttttaaaagggtttctcagacttttgaagcaaaattacatttcaaagataccaagccatttttaaacaaagattccactaacgaattcgtaggttctccttcattaacctcccctcaatatatcccaagtccactttcttcaacaaaacctccaggatcagtcaattctgctgccaaatacaaagacatgaagcttcttcgttactataaaaacatttggctgaacaataaaattatcaattgggaaatatcgaacccagacttcctatcaaaatattctgcgattacttcttctatatttcaagagagctttaattcagttcaaaacttggaccagttactcacagacttgattgagacatcgtttacttgttttgctcaattcgttagcaataagcaatatcatcaggcaaattctaatttgactctgttagaaagaaagtgggtcatatttataacaaaacatctaccattattaatcctggaaaactcttcaagaagtcctcgtgtagtcacgaatgctctggataatattgacgaaaaagtcgttaaagcaatcagaatatacttcaccgaaaaagatgataacaaaaccaataatgaagatctatttgatgattatccatctacaagcttggatataagacacgattttatcaaagggttgattatgttaaatttacagcctgcgtccgttatcaacaattacttaagagaggaccaaatgatcgacaccagtattttacctacccgtgatgatttgtttgttcgtaatttgcaaggcattcaagaagtcgtccataataccaacagtttcatcatttcatccttagatactttagagttagaatcgataaccgaatcgatcacacatgattcgagtaacggactatttcaagtattacacaattttgaatctgtagctccgacaaaacaacgtgagatagtaaaagcctttttatctatatttgaagatgcaataaaagaattgaattataatagaatagccaagatatgtgctcttttgtttttcaacttttcacattcattgaccacaattctatcattttcttcgccagcagcactaatgaaaacattgataaaattcgttgatttgtctagaaatggcagaaatggctcaaacggtaatgatgaaagttcagaatatgaaacgataaatatatctttgtcattttcttgggcaattttactgataatcaacctaacacaaacatatggcatatctgtggtggatgtggcacttaagtatcctgaattgagcataaaaaattcctttataatcaatttcatttcaaatctacctaatgtctcagataagtactatttggaagaatcaaatgtgaatgattcagatatgctaacaaagtctcataataccgttcaaagctggctttgtgatctttttgttaatgggtccataacagatcaattgatccaaaatattgaaacaaggcaattggctaatctcataccatttattgttaaacaggttttgctatctgttgaaataggcgttttaacggatatttcaagtctgataggtggcttcgaatatttcttacaacctttactattagttgggctaatcaaaactttttattggctagaacaatttctttcttgcgtcaagaacgacacaatatctgaagatattttacaagggatattcaatttattgaatacacttttcaacccagtaactcttaacgaggattcgaaagcgttccacacggctgtactgaggttgaatgcaattccactactcaaagttctccgcaaatttagagttcagagccagtcaaattatggtatctactcttctgatgcccaaggtgatcctaacttagaacctttgatagccaaattagttgccgttcttaatgtatcacccgtttatgacgtcgatccaagaattatcaattcagagaacgattattctagaaagcagttgggttacggtaaattcctaattttgaacgaaaacccgattaacaagataatgacgaaccaaattaactcattctggagtctccacagcagcacatattataacttagattatctatttgagttaattgaattggttaccccaaaaagtttcctttttgatgttttgaaaacattagaatataaactagccacttatggggtccctggttctgaaaataagaggggatcattggattcagagcatgttttcgattatttcttctactttcttgtactatatgatgtgaaaaccgcggaggaagccagtcaactaatagaatatatggagaacgacgcaaaaaaaagtaagggggacgttgatataaagggagaagacttacatgagaaaaatgactcagctgaggtgaggcaagaaactcaaccaaaagctgaagctacccaagacgatgatttcgatatgctttttggcgagaatgatacaagcactcaagcttacgaagaagaagaagagaatgaggataacgacggcaataatagaacaaacaatgtaccaatgataaaagcagaagaaactcctagtaaaactaataagatatccattttaaagagacattcgtttgcggtacttctgcatgaaagaaaattattgaatgatttagctttggaaaacggcgaaataaccaagacagaaaatgagaaatttatcagttatcacgataagtacttgtgtatgctgaaaacatgcgtattctga

SEQ ID NO: 381 - DNA, 1986 bp, Saccharomyces cerevisiae
atgcaaagttcagtttattttgaccaaacagggtcatttgcgtccagtagcgacaacgttgtgtctagtaccaccaacacacacaacatttctcccagtcatcgttccagtttgaatctgaacactacttctcatccccacgaagcgtcgggtagaggaagcgcaagtggggagttgtatttgaatgacacaaactcacccttagcgatatcttctatgctaaacacacttgcccttggaagtatgccccaagacattgcaagcagcaacattagcaatcacgataacaacattaaggggagctacagcctaaaattgtcaaatgtagccaaggatattactctcagagaatgctatgcaatcttcgctcttgctgaaggtgtgaaaagtatagaattacagaaaaaaaactcttcatcaagcatcacttctgcctcattagaagacgagaatgatatttttatcattgccagatttgagttattgaatctagctattaattatgccgttattttgaattcgaaaaatgaactctttggacccagttttcccaataaaacaaccgttgaaataatagatgacacaacaaaaaacttggtttcattcccatcatctgccattttcaatgacacctcaagattgaataaatcgaactcgggaatgaaaaggccaagtctgttatcacaaagatccaggttttcattcagcgatccattttccaatgattctcctttaagccaacagcaatctcaacagcagcagcaacagccacaacagccacaacaacactctacgcaaaaacattcaccacaacaatgtaatcaacaacaagtgaattcttcaataccgttatcttctcaaggccaggttattgggttacattctaaccattcacatcaagatttgtctgtggaatcaacaattcaaacatctgatattggcaaatctttccttttgagagataacactgaaattaatgaaaagatatggggcacaagcggtataccttccagcatcaacggttacatgagcactccccaaccttctacgccaactttagaatggggaaatacttctgcatcccaacatggttcttcgttctttttaccctctgcagcatcgacagccattgcacctacgaatagcaacaccagtgccaatgcaaacgccagctccaacaatggagccagcaataatggtgctaaccaggcactctctgccagctcgcaacaaccaatgatgcaaattggtaacacgattaacacttccctaacctcttcaaattcattgcctccatacggtttaatgtcttctcaatcgcagcacatttcaaatatggtaaacacctctgatatgaacattacacctcaaaaacagaacagatttatgcaacaaccccaaccagagcatatgtatcctgtgaatcaaagtaacactcctcaaaaagtaccgcccgcaagattaagttcaagtagaaattcacacaagaataactctactacctcattatcctcaaatattactggatctgcctcgatttctcaggctgatttgtcactactagccagaattccacctcctgccaaccctgctgatcaaaatccaccttgtaataccctttatgtagggaatttaccctccgacgctactgagcaagaactaagacagctattttctggtcaagaaggcttcagaagactatcattcaggaataagaataccacatctaatggtcatagtcacggaccgatgtgcttcgttgaattcgatgatgtcagttttgcaaccagagcgttagctgaattgtatggtagacagttacctcgctccactgtgagcagtaagggaggtatcagattaagcttttcaaaaaacccactgggtgttaggggcccaaacagcagaagaggaggcagtggtaacccaaatcctaatgtaaatatgctttccagttacaattctaatgttggtcatataaaaaactaa

SEQ ID NO: 382 - DNA, 2163 bp, Saccharomyces cerevisiae
atgaattcgaatgaagatatacatgaagaacgcattgaagttccacgaactccccatcaaacccagccagagaaagactctgatcgcatcgctctcagggatgaaatatcagtaccagaaggcgatgaaaaagcatattcggatgagaaagtagaaatggcaaccacaaatgcatccagtaactttggctcaaatgaaagtgcaaaagacggcgaatcaatcggcgccttttcaaatccccatgaggctctgatgcagtcaaaattgagagaagaatcccagagtaaaaccatactaccatccgatgacctcagccagcaattagaaaccgaagaatccaaagttgaagaggctctaaaaagaataacctcacccccattaccaccgagggctgactgcatagaagaatctgcatctgctcttaaatcctcattgcctccagtgctagcaggaaataaaaatgatcaagccccccttgaccgaccacagttacctccgaggcaggtagttaatgcggaaactcttcatttgaaggcgccccatggtaatgcgactccctccaaatcaccaacgagtgctgtaggtaattcttcttcatcgacccctccaaccttaccaccacgccgtatagaagatcctttagacttggctgctcaaaaacatttcctagcgagtacatttaagagaaatatgctcttttataaaagtgaagataactctatcaaatgtgatttggataaaaatatactaaatttaaaagaagattcaaaaaaaattaacaacaatgaaattcctgaagaggttagttcattttggttaaaggttatcggcgactatcaaaatatcttaataaacgatatcgaaaccttacatttccaactatctcgaggtataccagccgcttatcgattggtagtctggcagttagtaagttatgcaaaatcgaaatcctttgaccctatatatgaaacgtatctaacggaaatggcaccttttgacgtccaggaatttgaaaatcagctaaaaatgatggacgaagttccctctgaatacgtaaaacgcataagtaatgtgttaaaggcttatttactttttgacccagagtgtgagttttctaccgacattgcttatattatcaatatgattcttgacgtttgcgaggaggaggcaaatgcatttggtctacttgtacgcctaatgaaagtttacggtttaagactcttgttcttaccaagtgcttctgagatcgatattctttgctataaatttgatagacttgtagaagaattttatcctgaaattcacaaccacatggttgaaaaaggcgtccgttcttccatgtttttgcccggtttcttcacgacactgtttcaaaagaaacttcccactgaaattcaaccacgtatcggtgatatggtatttttagaaggtattgactctattatgagaattttagccacacttttatctaattcccgagaccatctgttaaaaatgggttttgatgatatgctggagctattgaaatcaggtctgttagatgcttatattaagcagaatgatggtacacgcggtgacactcttctctcaaatgaatgtatggataaattactacaagactctatgatgaaagtagcaataaccccaaagactatgaagaaatattcttctgaatatgaggaaattcacagattggacaatgaaaaagaagtgcaatataagtctatcacggaaaaaaatttacatttacaaaagcatgttcgtaaattagaaaacgactacacatctttaaatagagagcatgtgacaattgcgaacgagttagtgaaaaatcggcttaatatcgagtctgtattaaatgaaaataatggttacaaacttcaaattttagatttgaagaaaaagttggattcagaaaaaaagaagcaagttttaggtgtatatgtgcccaatgatttaaagaaagatttggaagagacaatgaaaaagaatacccaagtaatggacgaaaatttgaaattgcaggataggatttcagaactagaaaggcttattgaagaaataaaaactgcaaacaaaaatggtacgttattcgaatattctaattctaaaaataatcctttgggagccggctggtcaggatttaaaaaggtttttaaatag

SEQ ID NO: 383 - DNA, 1503 bp, Saccharomyces cerevisiae
atgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaa

SEQ ID NO: 384 - DNA, 369 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaagttgtcatttccgtcatggtcgggaaaaatgtaaaaaagttcctgacgtttgttgaagacgaaccagatttccagggcggaccaatcccttcaaacaaaccacgtgatggtctacacgttgtttcaagtgcatactttgaaattcaatag

SEQ ID NO: 385 - DNA, 1875 bp, Saccharomyces cerevisiae
atggacttgaatcaaagaaaggaaaaaaagggccagcatgttggatgctgtggctccaggacagacctgtctgctgacacagtggaactgatagaaagaatggacagattggctgaaaatcaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcatcaacgtcaggactagtgcgactaccactgccagcatcaacgtcaggactagtgcgactaccactgaaagtaccaactccaacactaatgctactaccactgaaagtaccaactccagcactaatgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacatatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtagggtatttgaaattttttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattgggttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtga

SEQ ID NO: 386 - DNA, 1785 bp, Saccharomyces cerevisiae
atgacaatggcaacaaccgcaatgaatgttagcgtacctccaccagatgaagaagaacagttactagccaaatttgtattcggtgatacaacagatttacaagaaaatctcgctaaatttaatgccgatttcattttcaatgaacaagaaatggatgttgaagaccaggaggatgagggatctgaatcagataacagtgaagaagatgaagcgcagaacggtgaattagaccatgttaacaacgatcagttattttttgtggacgatggtggtaacgaagatagtcaagataagaatgaagataccatggacgtggatgacgaagatgactcttcaagcgatgattattctgaggactctgaagaagctgcttggatagattcggatgatgaaaaaattaaagtgcctattcttgttaccaataagacaaagaaattaagaacctcctataacgagtccaaaatcaacggtgttcattacatcaacagattgagatctcagtttgaaaagatatatccaaggcccaaatgggtggacgatgaatctgattctgaattagatgacgaagaagacgatgaagaagaaggctctaataatgttattaatggagatattaatgctctaacgaagatcctgtctactacttacaattataaagacactttatcgaattccaaactattaccccctaagaaacttgacattgtgcgtcttaaagatgcaaatgcatcacacccgtctcattccgccatacaatctctttcattccatccttctaagcctctactgttaacgggtgggtatgataagaccttaagaatatatcatattgacgggaaaacgaaccatctagtgacaagtttgcacctggttgggtctccaatacaaacatgtactttctatacttctctatcaaaccaaaatcaacaaaatatattcaccgccggtagaagaagatatatgcattcctgggacttatccttagaaaatttaactcattcacagactgccaaaatcgaaaaattttccagattgtatggacatgagtccactcaaagatcatttgagaatttcaaagttgcacatttgcagaattcacaaacaaattctgtccatggaattgtccttttacagggtaataatggttggattaacattttacattccacttccggactatggttaatgggctgcaagatagaaggtgtgataacggatttctgtatcgattatcaacctatttcacgtggtaagtttaggaccattttaattgctgtaaacgcgtatggtgaagtgtgggaatttgacttgaataagaatggccatgttataagaagatggaaagaccaaggtggcgtgggtataacaaaaatccaagttggtggtgggacaacaactacttgtccggctcttcaaataagtaagataaagcaaaataggtggcttgcggtaggtagtgagagtggatttgttaatctttacgatagaaataatgctatgacctcgtcgacccctacacctgtcgccgccttggaccagctaacaactaccatttctaatctacaattttcccctgatggtcaaatactgtgcatggcatcccgtgcagtcaaggatgctttgagactagttcatctgccttcttgtagcgtgttcagcaactggcctaccagcgggacgcctttgggtaaagttaccagtgtcgcattttcgccatctggtgggctactggccgtgggtaacgaacaaggtaaagtgaggctctggaaattaaaccactactaa

SEQ ID NO: 387 - DNA, 411 bp, Saccharomyces cerevisiae
atgggagaaattttagaactaactaataagaatttcatgagccacttgaaaaaggacataacttcgcaagaatccttgaaaagtagaattgaggataaaaatggtgatgtcgctagcccgaaagaggataactatcctctattgaatgaaacagcggcatggccagatggggtgattacctctgaagaaggatgttcatcttcaggtgagaaagagaattcaggcttatgttcagaagaaagttcagaagaagatccagaagaagctgaagaggaatctgcaagggcttttggagagttagttgcagtcttgcgggacaaagacataccactgaatgtattggacgaacctcagatgaaagattggcttgaaaaatacaccggtgtttatagaagctcttggcatggttga

SEQ ID NO: 388 - DNA, 2433 bp, Saccharomyces cerevisiae
atggacaatcaggctacacagaggcttaacgacctttctctagaaccagctccttcacacgatgaacaagatggttcaggactagtcattgacatagatcaaagaaagattggtgatgaacaagctggtgtcgtagtggatgatgagacaccccccttagagcagcaagattcacacgaaagtttagctgctgattctcggaatgctaatttctcgtatcacgagaatcagcagttgttggaaaatggcaccaaacagttggccctagatgagcatgattctcactctgccatcttggagcaaccatcgcattctaccaattgtagctcttccaacatagcagcgatgaataagggccatgactcggcagaccatgcatctcaaaattccgggggtaaaccgaggaccttgtctgctagtgctcagcatatcttgccagagacgctcaagtcatttgccggcgctccggtagtgaataagcaggtacgtacctctgcctcctataaaatgggaatgttggctgatgatgcttcacagcagtttcttgatgatccctcttccgagttgattgacttgtattccaaagtggcagagtgtagaaatttgagagccaaatatcagaccatatctgtgcaaaacgatgatcaaaacccaaaaaataagccaggctgggtagtctatccaccaccacctaaaccttcatacaactcagacactaagactgttgtgccagtaacaaacaagccggatgcggaagttttcgattttacgaaatgtgaaattcctggtgaggatccagattgggaatttaccctcaacgatgacgactcgtacgtggtacacagatcaggtaagacggatgagttaattgctcaaatccctacccttcgtgactactatctggatctagaaaaaatgatttccatctcatcagacggtcccgctaaatcatttgcttatagaaggctgcaatacctagaagcacgctggaatctttactatctcttgaacgaatatcaagaaactagcgtttccaaaagaaacccacacagggatttttataatgttaggaaagtggacactcacgttcaccattctgcttgtatgaaccaaaagcacttattacgtttcattaaacacaaattgagacattccaaagatgaaaaggttattttcagggacgggaaactactaactttagacgaagtattccgttctttgcatttgactggatatgatttatccatcgatactttagatatgcatgcacataaggatacattccacagattcgataaattcaacttaaaatataaccctatcggtgaatctcgtctcagagaaatttttttgaagacaaacaactacatcaagggtacctacttggctgacattaccaaacaagtcatattcgatttagagaattcaaaataccaaaactgtgagtatagaatttctgtttatggcaggtctctcgatgaatgggataaactagctagctgggtgattgacaacaaagttatttcccataatgttcgttggttagtccaaattccgaggttatatgatatttacaagaaaactggcattgttcaaagcttccaggacatctgtaagaatctgtttcagccactatttgaagtgaccaaaaatcctcagtctcatccaaaattgcatgtatttttacagagagtaattgggtttgattctgtcgatgatgaatccaaggttgatcgccgctttcataggaaatatcccaagccatcactctgggaggctcctcaaaaccctccttattcctattacctgtactatttgtattcaaatgtcgcgtctttgaatcaatggagggctaagagagggtttaacactttggttttgagaccacattgtggtgaagccggtgaccccgagcatctcgtttcagcatatctattggcacatggtatatcacatggtattttattgaggaaagttccatttgttcaatacttatactatttagatcaggttggtatcgcaatgtcacccctttctaataacgcattatttttgacctatgataaaaacccatttccgagatactttaaaagaggtttgaatgtctcactatccacagatgatcctttacaattctcatataccagagaaccattaatcgaagaatactcagttgcagcacaaatttataaattgtctaatgtagatatgtgtgaattggcaagaaattccgtgttgcaaagtgggtgggaagcacaaatcaaaaaacattggatagggaaagattttgacaagagtggtgttgaaggtaacgatgtggttagaacaaatgttcctgatattagaattaactacagatacgatacattatcaactgaactggaattagttaatcattttgccaatttcaagagaaccattgaagaaaagtga

SEQ ID NO: 389 - DNA, 2589 bp, Saccharomyces cerevisiae
atgcagtacgtaggcagagctcttgggtctgtgtctaaaacatggtcttctatcaatccggctacgctatcaggtgctatagatgtcattgtagtggagcatccagacggaaggctatcatgttctccctttcatgtgaggttcggcaaatttcaaattctaaagccatctcaaaagaaagtccaagtgtttataaatgagaaactgagtaatatgccaatgaaactgagtgattctggagaagcctatttcgttttcgagatgggtgaccaggtcactgatgtccctgacgaattgcttgtgtcgcccgtgatgagcgccacatcaagcccccctcaatcacctgaaacatccatcttagaaggaggaaccgagggtgaaggtgaaggtgaaaatgaaaataagaagaaggaaaagaaagtgctagaggaaccagattttttagatatcaatgacactggagattcaggcagtaaaaatagtgaaactacagggtcgctttctcctactgaatcctctacaacgacaccaccagattcagttgaagagaggaagcttgttgagcagcgtacaaagaactttcagcaaaaactaaacaaaaaactcactgaaatccatatacccagtaaacttgataacaatggcgacttactactagacactgaaggttacaagccaaacaagaatatgatgcatgacacagacatacaactgaagcagttgttaaaggacgaattcggtaatgattcagatatttccagttttatcaaggaggacaaaaatggcaacatcaagatcgtaaatccttacgagcaccttactgatttatctcctccaggtacgcctccaacaatggccacaagcggatcagttttaggcttagatgcaatggaatcaggaagtactttgaattcgttatcttcttcaccttctggttccgatactgaggacgaaacatcatttagcaaagaacaaagcagtaaaagtgaaaaaactagcaagaaaggaacagcagggagcggtgagaccgagaaaagatacatacgaacgataagattgactaatgaccagttaaagtgcctaaatttaacttatggtgaaaatgatctgaaattttccgtagatcacggaaaagctattgttacgtcaaaattattcgtttggaggtgggatgttccaattgttatcagtgatattgatggcaccatcacaaaatcggacgctttaggccatgttctggcaatgataggaaaagactggacgcacttgggtgtagccaagttatttagcgagatctccaggaatggctataatatactctatctaactgcaagaagtgctggacaagctgattccacgaggagttatttgcgatcaattgaacagaatggcagcaaactaccaaatgggcctgtgattttatcacccgatagaacgatggctgcgttaaggcgggaagtaatactaaaaaaacctgaagtctttaaaatcgcgtgtctaaacgacataagatccttgtattttgaagacagtgataacgaagtggatacagaggaaaaatcaacaccattttttgccggctttggtaataggattactgatgctttatcttacagaactgtggggatacctagttcaagaattttcacaataaatacagagggtgaggttcatatggaattattggagttagcaggttacagaagctcctatattcatatcaatgagcttgtcgatcatttctttccaccagtcagccttgatagtgtcgatctaagaactaatacttccatggttcctggctccccccctaatagaacgttggataactttgactcagaaattacttcaggtcgcaaaacgctatttagaggcaatcaggaagagaaattcacagacgtaaatttttggagagacccgttagtcgacatcgacaacttatcggatattagcaatgatgattctgataacatcgatgaagatactgacgtatcacaacaaagcaacattagtagaaatagggcaaattcagtcaaaaccgccaaggtcactaaagccccgcaaagaaatgtgagcggcagcacaaataacaacgaagttttagccgcttcgtctgatgtagaaaatgcgtctgacctggtgagttcccatagtagctcaggatccacgcccaataaatctacaatgtccaaaggggacattggaaaacaaatatatttggagctaggttctccacttgcatcgccaaaactaagatatttagacgatatggatgatgaagactccaattacaatagaactaaatcaaggagagcatcttctgcagccgcgactagtatcgataaagagttcaaaaagctctctgtgtcaaaggccggcgctccaacaagaattgtttcaaagatcaacgtttcaaatgacgtacattcacttgggaattcagataccgaatcacgaagggagcaaagtgttaatgaaacagggcgcaatcagctaccccacaactcaatggacgataaagatttggattcaagagtaagcgatgaattcgatgacgatgaattcgacgaagatgaattcgaagattaa

SEQ ID NO: 390 - DNA, 3141 bp, Saccharomyces cerevisiae
atgaatatgaacgagtccatttccaaagatggtcaaggcgaagaagaacaaaataatttttcgtttggtggtaagcccggttcctatgattccaattcagattctgctcaacgcaaaaagtctttcagtactacaaagccgaccgaatataacttaccaaaagaacagcccgaatcaacgtccaagaatttggaaaccaaggctaaaaacattctgttaccttggaggaagaagcataataaagactcggaaactccacacgaagacactgaggcggacgctaaccgccgtgccaacgtaacttctgatgtgaaccctgtttctgccgacaccaagtcaagttctggccctaatgctactattactacccatggatactcttatgtcaaaacaacgacacccgctgctacaagtgagcaatccaaagtgaaaacgtcacctcccactagccatgaacattcaaatataaaggcgtcccccactgcgcatagacattccaaaggtgatgcagggcatccaagtattgcaaccactcataaccacagcacttccaaagctgccacttctcctgttactcacacgcatggtcattccagtgctaccacttcccctgtcactcacacacatggtcatgccagtgtgaaaaccacatctcctaccaatactcatgagcattctaaagcgaatactggtccatcagccactgcaactacacatggacatatcaacgtcaaaactacccaccctgttagccatggtcactctggttcaagcactggtcctaaatccaccgctgctgcacaggatcattccagtactaaaactaacccttcagttactcatggacatacaagtgttaaagataactcctcagctacgaagggttattcgaacactgattccaactcagatcgagatgtcatacctggtagtttccggggcatgactggtactgatgtgaaccctgttgatcctagtgtttacacaagtacaggcccaaagagtaatgttagttccggtatgaacgctgtcgaccctagtgtctacacggacacaagttcgaagtctgcagatcgtagaaagtactctggcaacactgcgactggtcctcctcaagatacaattaaagaaattgcacagaacgtgaagatggatgagagcgaacaaactggattgaaaaatgaccaagtttctggttctgatgcaatccaacagcaaactatggaacctgaacccaaagcagcagtcgggacaagtggttttgtaagccagcaaccttcttatcatgatagcaataaaaacattcaacacccagaaaagaataaggttgataataaaaatatatcagaaagagcggctgaaaaatttaacattgaaagagatgacattctggaatccgccgatgattatcaacagaaaaacattaaatccaagacggattctaattggggtccaattgaatatagttccagcgctggtaaaaataagaatctgcaggatgttgttataccttctagtatgaaggagaaattcgacagcggtacatctggatctcagaatatgcctaaagcgggaaccgaattaggacatatgaagtataatgataatggtagggataacttgcaatatgttgccggttcacaagctggttctcaaaatacgaacaacaatattgacatgtcaccccgtcatgaagcagaatggtccgggctttctaatgatgccaccacccgaaacaatgttgtatcacctgctatgaaggacgaagatatgaatgaagattctactaaacctcatcaatatgggttggattatttggatgatgttgaagactaccacgagaatgatattgacgactactcaaatgcaaagaaaaacgacttgtattctaagaaagcgtaccagggaaaaccatcggattacaattatgagcagagagagaaaatcccaggtacttttgaacctgatacgttgtcaaaatcagtgcaaaaacaagatgaagacccgttgtctccaaggcaaaccactaaccgtgctggtatggagactgcaagagatgagagtcttggcaattacgaatactcgaatacttctggtaacaaaaaattatctgatttaagcaaaaataaatcaggcccaactccaacgcgttctaattttattgaccaaattgagccaagaagagcaaaaacaacacaggatattgcatccgatgccaaggatttcaccaataatccggaaacaggtactactggaaacgtagatacaaccggaaggatgggtgcaaaatccaagaccttcagctcgaacccttttgatgatagtaaaaatacagacactcatctcgaaaacgctaatgttgctgcctttgataattccagatctggagacactacatactccaaatcaggggatgctgaaacagctgcttacgataatattaaaaatgcggaccctacatatgccaaatcacaagatattactggaatgactcacgatcaggaaccatcatcagaacaaaaggccagttacggttctggcggcaattcccaaaatcaagaatattctagcgacgataatattgatgtcaataagaatgcgaaagttttagaggaagacgcaccgggctacaagcgtgaagtagatttgaagaacaaacgtagaaccgaccttggtggtgccgacgcctcaaacgcttatgctgccgaagttggtaatttccctagtttgattgacccacatgtcccaacatacggatttaaagacaccaacacctctagttctcaaaagccatctgagggcacctacccagaaaccacttcctattcaattcataatgaaacaacttctcagggaaggaaagtgtcggtgggttcaatgggttccggaaaatcaaaacatcatcacaatcatcaccgtcacagcagacagaattcttcaaaagggtctgactacgactataataattctactcattcagccgagcacactccaagacatcatcagtacggttccgatgagggtgagcaagattaccatgacgacgagcaaggtgaggaacaggctggtaaacaaagtttcatgggtagagtgagaaaaagtatttctggcggtacttttggatttaggagtgaaatttaa

SEQ ID NO: 391 - DNA, 2958 bp, Saccharomyces cerevisiae
atggctatctgggagcaactagaagtctcaaaggcgcacgttgcttatgcatgtgttggtgtcttttcatctatcttctctttagtgtcactttatgtcaaggagaagctttatattggtgagtccaccgtagcaggtatatttgggctaattgtgggtcctgtttgcttgaactggtttaatcctctgaaatgggggaattcagacagtataacattagagataacgagaatagtattatgtttgcaaatttttgccgttgccgtggaactgccacggaaatatatgttgaagcattgggtatctgtgacgatgctattattgccagtgatgacagctggatggcttattattggtctcttcgtttggattcttatacctggcttgaatttttctgctagtttgttgatatctgcgtgcattaccgcaacagatcctattctggcgcagtcggtcgtctccggtaagtttgcccaaagagtacctggtcacttaagaaatctactgtctgcagagtcaggctgcaatgatggtatggcctttccttttttatttctttctatgaatttaatcctacatcccggtaatggaagagaaattgtcaaagattggatttgcgttactatcctgtatgagtgtttgtttggatgcttgctaggttgcttcattggttatgtaggcagaatcaccatcaggtttgccgaaaagaaaaacattatcgatcgtgagtcgttcttagcattttacgttgtcctggcgttcatgtgtgctgggttcggctccattttgggtgtggatgacctattggtatcatttgcagccggtgcgactttcgcttgggatgggtggttttctcaaaagacacaagaaagtaatgtttctaccgtgattgatttgctactaaactatgcgtattttatctattttggtgccattataccttggagtcaattcaacaacggtgaaattggcacaaacgtctggcgtttaattatactttcgatagtggtcatctttttacgtaggatccctgcagtcatgatattaagacctcttatacctgatataaaatcgtggcgtgaggcactttttgtgggccattttggtcctattggtgtaggtgcaatttttgccgctatactagctcgtggagaattagagtctacctttagtgacgaacccactcctttaaatgttgtaccatcaaaagaggaaagtaaacattggcagctgatagcctgtatatggccaataacttgttttttcattgttacttctatcatagttcatggttcttcagttgcaatcataactctaggtcgtcatttgaacacgataacgttaaccaaaacattcactacacacaccaccaatggtgataatgggaaaagttcatggatgcaaaggttgccatcgttggataaagctggacgatcattttcattgcatcgtatggatactcaaatgactttatcaggggatgaaggtgaagcagaagaaggaggaggtcgtaagggactagcaggaggtgaagatgaagaaggattaaacaatgatcaaattggtagcgtcgcaacgagcggaattcctgcaagacccgctggtggtatgccaaggaggaggaaattgtcaagaaaagagaaaagattgaacagaagacagaaactgagaaacaaaggtagagaaatattttcatcaagatctaaaaatgaaatgtatgatgacgatgagttgaatgatctgggacgagaaaggttgcaaaaagaaaaggaagcacgcgccgccacatttgcattgagcacagccgtcaatacacaacgtaatgaggagattggaatgggtggagatgaagaagaagatgagtacacaccggaaaaggaatatagcgataattacaataacacaccaagttttgagtcgtctgaaagatcttcatctctccgaggaagaacttacgtaccaagaaaccgttacgatggagaagagacagaaagcgagattgaaagcgaagacgagatggaaaatgaaagtgaaagatcaatggccagtagtgaagagaggagaattcgaaaaatgaaagaggaagaaatgaaacctggtactgcttatttagatggtaatagaatgattattgaaaataagcaaggtgaaatcttgaatcaagtagatatcgaggatcgcaatgaggcgagagatgacgaagttagtgttgatagtacagcccattcaagtttaactaccacaatgaccaatctatccagtagtagtgggggaaggttaaagagaattttaactcccacatctttaggaaagatacattcattggttgataaaggaaaggataaaaataaaaacagcaagtatcatgcatttaaaatagacaatctgttaatcatcgagaatgaggacggtgatgttataaaaagatacaagataaatcctcataaatctgatgatgataaaagtaaaaaccgcccaagaaacgatagtgttgtatcaagagctttaacagcagtaggactaaagagcaaagcgaacagcggcgtaccgcctccagtagatgaagaaaaagccatcgaaggaccctccaggaagggcccagggatgttaaagaaaaggacattaacacctgcgccaccgagaggagttcaagattccttagatctggaagatgaaccttcatctgaggaggatttaggtgatagttataacatggacgatagtgaagattacgacgataatgcatatgaatcagaaactgaattcgaaagacaaagaaggttaaatgcgttaggtgagatgacggcaccagcggatcaagatgacgaagagttgccgcccttacctgtggaggcacaaacaggaaacgatggtccaggtacagcggaaggaaaaaaaaagcaaaagagtgctgctgttaagtcggcgctatcaaaaacgcttggtctcaataagtaa

SEQ ID NO: 392 - DNA, 168 bp, Saccharomyces cerevisiae
atggtcaaattaacttcaatcgctgccggtgtcgccgccattgctgctggtgcctccgccgcagcaaccactacattatctcaatctgacgaaagagttaatttggttgaattaggtgtttatgtttccgatatcagagctcatttggctgaatactactctttctaa

SEQ ID NO: 393 - DNA, 2454 bp, Saccharomyces cerevisiae
atggcaggtgctccagctcctcctcctccaccgcctccaccagcattaggtggtagtgctcctaaaccggcaaaatctgtgatgcagggccgtgacgccctgttaggtgacattagaaagggaatgaaactaaagaaagctgagaccaatgatagaagtgccccaatcgtgggaggtggtgtcgtttcatcggcctcaggaagttctggtaccgtcagtagtaaaggaccctctatgtcagctcctccaatccctgggatgggcgctccgcagttgggcgatattttagctggaggtataccgaagttaaaacatatcaataacaatgcaagcactaaaccctctccatcggcgagcgcaccgccaattccgggcgcggtgccatctgttgcggctccccccattcctaatgcaccattatcaccagcacccgctgttcctagtattccctcgtcttctgcacctccaattcctgatattccatcttctgcggcccctcctattcccattgtaccatcatctccagcaccaccgcttccattatcaggtgcctctgctccaaaggtaccgcaaaatagaccgcatatgccttcagtaaggccagcacacagaagccaccaaagaaaaagctctaatatttctcttcctagtgtgtcagcaccccctttgccttcagcgtctctgccaacacatgttagcaaccctccacaagctccaccccctcccccaactccaacaattggcctggactcaaaaaacattaaacctacagataacgcagtctcaccaccatcttctgaagttcctgcaggcgggttgccatttttggcagaaattaatgccaggaggtctgaacgaggagccgtcgagggcgtttcttccacaaagattcaaaccgaaaatcataaatctccttcacaaccaccacttccatcatctgctccgcccattcctacatcacatgctccgccattaccgcctactgcaccacctccaccatcgttaccaaatgtgacctctgcacctaaaaaagcaacttcagctccagctccgcctccaccaccactaccagcagccatgagctctgcgtcgactaacagcgtaaaagcaaccccggttcccccaactttagcaccaccgttaccaaatactacatcagttcctcctaacaaagcatcgtcaatgcccgcgccaccacctcctcctcccccaccacctggtgctttttcaacatcctctgccttgtcagcatcatctattcctttagcaccactaccacctcctcctcctccttcggttgcaacgtcagtaccatcggctcctcctcctcctccaacactcacgacaaacaaaccctcagcgtccagtaagcaatccaaaatatcttcatccagttcttcctcggccgtaacacctgggggacccttaccatttcttgctgagatccaaaagaagagagatgatagattcgtggttggtggtgatactggatacactacccaagataaacaagaggatgtaataggttcatctaaggatgataacgtaagaccttctcctatttctccatctataaacccgcctaaacagagtagccaaaatggtatgtcgtttctggatgaaattgaatccaaattacataagcaaacatcatcgaatgcttttaacgcaccacccccccatacggatgctatggcgcctcctttgcctcctagtgcacctcctcctcctataacatcgctaccgactccaactgcatcaggtgatgaccacaccaatgataagagtgagactgtgttagggatgaaaaaagcaaaggcccctgcactgcctggacacgttccacctccaccagttccaccagttttatcagatgatagcaagaataatgtccccgccgcttctttattacacgatgttcttccctcctcgaatctcgaaaaacctccttctcctcctgttgcagctgctccgccattgccaacatttagtgcaccaagtctgcctcagcaatccgtgtctacatcaataccatcacctcctcctgttgcgcctacactttccgttcgtaccgaaactgaatcaatttcgaagaaccccactaagtcgccacccccaccaccaagtccatctacgatggataccggtacctctaatagccccagtaaaaaccttaaacaacggttattttctacaggtggatcgacgctgcaacacaagcataatacgcatacaaatcaaccagatgttgatgtaggtaggtatacgatagggggatcgaattctatcgttggggccaaatctggaaatgaaagaattgttatagatgattcaagatttaaatggactaatgtgtcacaaatgcctaagccacgtccctttcaaaataaaacaaaactgtatccaagtggaaagggtagtagtgtgccattggacttaacattatttacgtga

SEQ ID NO: 394 - DNA, 1788 bp, Saccharomyces cerevisiae
atgcctaccgtctccgtgaacaagcagcaattatttgatcttctaggcaaaaactacacttcccaagagttcgatgaattatgttttgaattcggtatggaaatggacgaagacaccacagaggaggccttgaaaaccggggaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgttcacattattgaggattctccagtcttcccagttattatggacagcaaagatcgtgtttgctccctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggttgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggtttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattgcctggtatcttaaagacagtcaaggaaaacagaaaacattccttgccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacttcccaggtagaggtgccaaggtcatgttcagatccaaagaaggcgctgagccaaagcaaatcggccacttgggtgtcttgcatcctgaagtcatgatgaatttcgacgttccattcgctgcatcctttgtagaggttaatgccgaagtcttcctataa

SEQ ID NO: 395 - DNA, 2640 bp, Saccharomyces cerevisiae
atggaaatgaacatggatatggatatggatatggaactcgcatccatagtttcttctttaagcgccctgtcccatagtaacaacaacggcggtcaggccgccgcggccggcattgtgaacggcggtgctgctggatcacagcaaattggcggcttcagaaggtcgagtttcaccacggcaaatgaagtagattcagagatcttgctgcttcacggttccagtgaatcttcaccgatcttcaagaaaaccgccctatcagttggtactgctccgccattctccacgaactcgaaaaagttttttggtaacggcggcaattattaccagtacagatcaaccgacactgcctccctgtcatccgcatcgtacaataactatcatactcatcatactgcggctaatctcgggaaaaacaacaaggtcaaccatcttctgggccagtattcagcttccattgctggtcccgtttactacaatggcaatgacaacaacaactctggtggggaagggttttttgagaagttcggaaaatctttgattgacggtacaagggaactggaatctcaagatagacccgacgctgtcaatactcagtcccaattcatatcaaaaagcgtctctaacgccagcttagacacacagaatactttcgagcaaaatgtcgagtctgacaaaaacttcaacaaattgaataggaacactactaacagtggttcgctttaccactccagttcaaattcaggctcatctgcgtctttagagtccgaaaatgctcattaccccaagagaaatatctggaacgtagccaacacaccagtatttagacctagtaacaatccagccgctgttggggccacaaatgtcgcgcttcctaaccaacaagatgggcctgcaaataacaatttccccccctacatgaacggcttcccacccaatcagtttcatcagggccctcattaccaaaacttccccaactacttgatcggatctccttcaaatttcatctcccagatgatttcagtacagattccagcaaatgaagacaccgaagactcaaatggtaagaaaaagaagaaggcaaacagaccttcttctgtttcttcaccttcgtcccctccaaacaattctccgttcccgtttgcctaccccaacccaatgatgtttatgccacctccaccactctctgctccccagcaacaacagcaacagcaacaacaacaacaacaagaagaccaacaacagcaacagcaacaggagaatccttatatttactaccctactccaaatcctatacctgtcaaaatgcccaaggacgaaaaaaccttcaagaaaagaaataacaagaatcatcctgcaaataactccaacaacgccaacaaacaggcaaatccttatctagaaaattctatacccacaaagaatacctctaaaaagaatgcttcttccaaatctaatgagtcaacggccaacaaccataaatctcactctcattctcatcctcattctcaaagtctacagcaacagcagcaaacgtatcatcgatcgccgttgttagagcaactaagaaacagtagttctgacaaaaattcaaactcgaacatgtcactaaaagacatctttggccattccttagagttttgcaaagatcaacatggttcacggttcattcagcgcgagttggccacctcaccagcctcagaaaaggaggtcatattcaatgaaattcgcgatgacgccattgagctttcgaacgatgtatttggtaattacgtcattcagaagttttttgaatttggtagcaaaattcaaaaaaatactttggttgatcaatttaaaggtaacatgaaacagttatctctacaaatgtacgcatgtcgtgtaattcaaaaggcgttagaatatattgattccaatcaaagaattgagttagtcctggaattatctgactccgttttgcaaatgatcaaagatcagaacggtaatcacgtaattcaaaaggccatcgaaacaattcctatcgaaaaattaccttttatcttaagttctttaactggccacatttaccatctatctacccactcctacggctgtagggtcattcaaagattgttagaatttggttcgagcgaagatcaggaaagcattttaaacgaattgaaagatttcataccatatctaattcaagaccaatatggtaactatgtcattcaatatgttttgcaacaagatcagttcaccaataaggaaatggtcgatatcaaacaggaaatcatagaaactgtggccaataatgttgtcgaatactctaaacataaatttgcctccaacgtggtcgaaaaatctattctttatggctctaaaaatcagaaggatttaataatttctaagattttaccaagagacaaaaatcatgctttgaatctggaagacgattctccaatgattttaatgatcaaggatcaatttgccaactatgtgattcaaaaattagttaatgtctctgagggtgagggtaagaaattgatcgtcattgccattagagcatatttggataaactaaacaaatctaactccctaggaaatagacatttagccagtgttgagaaacttgcagcattggttgaaaatgcggaggtgtga

SEQ ID NO: 396 - DNA, 2040 bp, Saccharomyces cerevisiae
atgccatcggaagttacgccaaaagtacctgagaggccctcaaggaggaagacatctgagctgtttccgttatccggctctgaatcaggagatattaaagctaatagcgagccaccaacaccagcaggaacgcccaatgtaccaacacgtagacccatacttaaagcaaagacgatgacttcgtttgagagtggtatggatcaagagagtttgcccaaggtaccattgcagaggccagttagacgctccactactgaagaactaaataatgtaatgaataacaccagtaaggagttagaggagattgaaagtttgatttcaaagcacaatatacacaatgtttccaggaaaaaaagtccaacttctgtggaagagggaaaggtggccgccattcatcaaaacgggcaaagaagtgcatcagataacaaaacttctacaaatccctccccactcgaaaaaaatgagcacgagggtgctgagggcaatgagtctgctatttcaccttctaatttagttaacaagtctaataatgaagtgacagagcatagtgactccgaagaccttactgaaaagcaaaaggtacatgctgccctagataatgaggcaggggatagaagccattttgaagaaaagctcattcctggagatatgaaagtacaggtagatgttagtaaggacgtagaagaaggcagcctcaatgctctgcctccatctggaatcacagaatcagacgacaaagctgaaaagttcactaaacatcctgaatctagtttagaagagctacagaagcatcaagaacaacaggaagaaaaaattttccaaaatccaaccgatgaagaaagtactacctctttgaatgagaaacaagaaggcaaggacaacatggaagtgaattctcagccgcaaggaccttctgatactgaaacagttatagcagcaactagctcaaacgttccttcacaaattgcaagtgaagaggaaaatgacgttccagtgattccaaggagtaggcctaagaaggattttgaagcacacgtacaaaaagaggagttgcctaacacacaagagaagcgagtatcagaagagtgtgattcgaccctaattagtaccgaagaggaaagtaaaatcccaaaaattccctctgaaagaccaaagagacgtgccccacctccggttcccaaaaaaccttcttcaagaattgcggcctttcaagaaatgttacaaaaacaacagcaacaagatctgcataataatggtaattcttcagctactaccgcttcagcagatattgctaaaaaacacacagattcttctattactagcgataccacgaaggcagattttacgagcaaattgaatggactgtttgcgctacctggtatggtgaaccctggacagcttccaccttccttggagaagaagttgtcctccccggatactgaatctaagctaggaccccaggaccaatcacaggcaaaaacgggacctctgggcggaactagaagaggtagaggacctcgtgggcgtaaattaccttctaaagtagctagcgtagagaagattgaagaagatgacaacactaataaaatagaaatatttaacaattggaatgtttcctcttccttctctaaggaaaaagtcttaatagatactactcctggtgagcaagcagaaagggccttggatgaaaagtcaaagagcattcccgaggaacaacgagaacaatctccaaataagatggaggctgctctttgtccttttgagctggacgaaaaggaaaagttacctgctaatgctgagtcggatcctctttctcagttgccacagacgaacgccgtaggtaatagaaaagccataagtgaggaatctctgtccccatcggaggccatcgccaacagagatcaaaacgatacgacagaaatacaggaacagcagatggaggaccaaatggaggttgatatggaaagagaactctcaggtggctacgaagacgttgattctgccttacattcagaagaagcgtcttttcactccctttag

SEQ ID NO: 397 - DNA, 2841 bp, Saccharomyces cerevisiae
atgtctgataatttgttatctttagagaatccggtggtgcctagtcactatgagttgcgtctagaaattgaccctaagcagtcgtcgcccaatttcaaaggatccgccataatccatttgaaattcaatccgaactccaccaccttagcttctatcgaagacagttttacccagttcaagttacattccaaggatttgattgtgttgtctgcacatgccaccatagggtctactaagtttgatctaaaaatttctcaggacactggaaagcatttgtcgattttcaactctgaatctcctattcaattgtccaacgattgccctctgattttgtccgtgcaatacgtgggtaaaattcgtgacataaaaacacatcatgataagacttttggtattttcaaaaccaattttatggatcgtaaaaccggtactgccaataatcacgtcgttgctactcactgccaaccgttttccgctagcaatattttcccatgtattgacgagccttcaaacaagtccacttttcaattgaacattgcaacggatgcacaatataaagccgtttccaatactcctgtagagatggtcgaagctttggatagttctcaaaaacatttggtgaaatttgccaagacacctttgatgactacttccgtatttggtttttctattggtgatttagaatttttgaaaacggaaatcaagttggaaggtgataggactattcccgtttcaatttatgcaccttgggatattgctaatgcagctttcactttagatacagtccagaaatatctacctttgttggaatcctattttaaatgtccataccctctgccaaagttagatttcgtcctactaccatatttaagtgacatggcaatggagaactttggtatgatcaccatccaactaaaccacctgctcataccaccaaatgccttggccaatgaaaccgtcagagagcaagcacagcaactcattgtccacgaactcgttcatcaatggatgggcaactacatatcttttgactcgtgggaatctctttggtttaatgagtctttcgctacttggttagcttgccacatactagaacagaatggtgacctatcccattattggacctcggaaccttatttactacagcaagtggagccgaccatgtgcagagatgcagctgacgttaatggaagaagcatatttcagattgcgcaacggaacactggcatagattctcaaacctccgatatttttgatcctgaggcatacacaaagggtattatcatgctgaggtccctgcaattggctacaggcgaatctcatctacaaaagggcctggaaagtgtatttgaagatactaaaacatttcatgcgagaagcgtcaaaccaatggatatatggaatcatatcggaaaatttttgaagtctcaaaatattacaaactttgtttcatcttggacaagaacgccaggcttacctgtcgttaaggtcgaagtagaagagaaagacgggaaaacgcaaacaaaattgactcaacacagatttatcaatcaattatctactgaagaaaaggatcagttagaagatgtcccatatcaggtacccttattcggggttctgccagatggtaaaatggatactaaaaatgtactattgacggataggaccttaaagttcgattatcctatcttagtaattaaccatttagcccaaggttattaccgcgtttcatatgagtccgaagagtgctatgcattgattaatgataaaataactgaggagacgttatccgagattgaccttcggaagattttcttagacttgtcgcagtttattggagatgagggtttccagaattctattcatttgcacggtctctttaagatactaaaccatatcgcttctccttccacaaagattgcatcaaaatattgggatcctctttccaaggggttggaagttctgcaaacgatcgatcgtgccagtttaacgagctctaaattacaatctttcttaaagaaaaaaattgtcattccccttttcaataagattgattggccccacggtgaatttgataaaagcacaaaccctcacgagttgaaagtcatgtctcaagtcttgtttttaaataaaaactccgcaaaatgtgctgaattgtgtcaaatttattttaaacatctattacagggcccacgttcgagcgtaccgttagaattagtgaactcaatccttgtcgtcgtatcgcaacattgtgcaaacatcaagcagtggaagaaaatattcgatttggtgaaacgcagttcctgtactggtatcacaaaccatgtcattaatatgtatgaccaaaacagtagcgaaaccgccatgttgattcaaaacggtgcaatagaatctcttggattctgtttagattctgatatcgtgaaaaaaactttgaattttatcacttccaatattgagtcagaggggatggaactggcattattcggatttaattacaactttaagaagaggctgaacaaaaacgagaaacctcaagaccaagtcgttcgtgaaacgatctgggagtggtatatgggcaattttgaccaatgggcacggaaggctacaaggaaaggtaccaccacgggggatcatctacacaaggcgttaaggagtatttccctgataatctttcaaatgtttgtagcagacgagccacagaagatagaaaagtttattaatttggagaaagagaagttgggtcaaagcttgttatctttggacgacatctgggcctctgtccagcaagatgaagagtccagaaagactataagaagagacttggcctccttggtctga

SEQ ID NO: 398 - DNA, 1107 bp, Saccharomyces cerevisiae
atgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttga

SEQ ID NO: 399 - DNA, 1875 bp, Saccharomyces cerevisiae
atggtggtgcagaaaaaacttagggctatcttgaccgatgaaggtgtattgatcaaatcgcaatcacaccatatgttcaataagcatggtcaactcagaagcggagattctttatccttgttgagctgcttgtcctgtctggatgatggaactttgagctctgatggaggttcttttgatgaggatgattccctggaactgttgcctcttaatactaccattccgttcaacagaattttgaacgcaaaatatgtgaatgtcggtcagaaaggcttcaataatggcaaaatttcttcgaatccttttcaaacggaaaatctgagttcttcgtctgaaaatgacgacgttgagaatcatagtttgagcaatgataaggctcctgtaagcgaatcacagtcatttcccaaaaaagacaagtgggatacaaaaacgaacactgtgaaggtgtctcccgatgattcacaggataactcaccatctttagggataaaagataatcaacagttaattgagttaacttttgctgtacccaagggccatgatgttataccacaaaaattaaccttgttaatagatcacgtttctaggaaatcgagagcaaataccggagaggagaacatttcttctggtactgtggaagaaatcctggaaaaaagttatgaaaattccaagagaaacagatcgatattagtcattattaatccccacggtggtaaaggtactgctaaaaatttattcctgacaaaagcaaggccaatactagtggaaagtggctgcaaaatagaaattgcatacacaaaatatgcccgtcacgccatcgatattgccaaagatttagatatcagcaaatacgataccattgcatgtgcctcgggtgatggtattccatacgaagtaattaatgggctttatagaagacccgacagagtggatgcgttcaataaactagccgtaactcagctaccttgcggttcaggaaatgctatgagcatttcatgtcattggacaaataacccatcgtacgccgctctgtgccttgtcaaatccattgaaacaagaatagacttaatgtgttgttcccaaccttcttatatgaacgaatggccaagattatcctttttgagtcagacgtacggcgttattgcagaatctgatattaacactgaattcatcagatggatgggtcccgttaggtttaatttgggtgtagcattcaacattatccaaggtaagaaatatccctgcgaagttttcgtcaaatatgctgccaaatctaaaaaggaattaaaagttcatttcttagaaaataaagataaaaacaaaggatgtttaaccttcgaaccaaatcctagcccaaactcttcgccggatttactatctaaaaacaatatcaacaacagtacaaaagatgaactttcaccgaattttctcaacgaggacaactttaaattaaagtatccgatgacggaaccagtacctagagactgggagaaaatggattcagagctaactgataacttaacaatcttttacacagggaaaatgccgtatattgctaaggacaccaaattttttcccgctgctttaccagcggatggtaccattgatttagtcataacggatgcaagaatcccagtgacaagaatgacaccaattttattatccttggataaaggttctcatgtattagagccagaagttattcactcaaaaatattggcttataagattataccaaaagtggagtcaggtttattttcagtggatggtgaaaagtttcctttggaacccttgcaagtggaaataatgcccatgttatgcaagacgttgctaaggaatggtagatatatcgatacagagtttgaatccatgtag

SEQ ID NO: 400 - DNA, 858 bp, Saccharomyces cerevisiae
atgtcctccgatttagctgctgagttaggattcgaccctgcactaaagaagaaaaagaagactaagaaggtgatcccagatgattttgatgctgccgtaaacggcaaagaaaatggttcaggagatgatttatttgccggattaaaaaagaaaaagaagaagtccaagagcgtttctgccgatgctgaagctgaaaaagagcctactgacgacatagcagaagccttgggtgaactatccttgaagaagaaaaagaaaaagacaaaggacagcagtgtagacgcgtttgagaaagaactagctaaagctggtctagataatgtggatgctgaaagcaaagaaggcactccaagtgctaattccagcattcaacaagaagttggcctaccttattcagagttattatctagatttttcaatattctaagaactaacaatccagaacttgctggtgatagaagtggtccaaagttcagaattcctcctcctgtttgtttgcgtgatggtaagaagactattttctcgaatatccaagatatcgccgaaaaattgcatagatctccggaacatttgattcaatatctcttcgcagaattaggtacgtccggttctgttgacggtcagaaaagattagtcattaagggtaagtttcaatccaaacaaatggagaatgtcttaagaagatacattttggagtatgtcacttgtaaaacttgtaagagtattaacaccgaattgaagagagaacagtcaaacagactgttctttatggtctgtaaaagttgtggttctaccagatccgtctcttctattaaaaccggtttccaagctaccgttggtaagagaaggagaatgtga

SEQ ID NO: 401 - DNA, 951 bp, Saccharomyces cerevisiae
atggcatttagtgattttgctgccatatgctcaaagaccccgttgccattatgttcggtaataaagtctaaaacccatctaatactttcgaactcaacaattatacatgattttgatcctttaaatttgaatgtcggtgtactgccacgctgttatgctcggtcgattgatcttgccaatacagtcatctttgatgtcgggaacgcattcataaatattggtgctctaggtgtcattttaatcatactttataacataagacagaagtatactgctattggcaggtctgaatatctctactttttccaactaacattgctattgataatatttaccttggtggtagactgtggtgtatctccccccggctctgggtcatatccatacttcgtggctatacaaataggactggcgggtgcatgttgctgggccttattgataatcgggtttttaggtttcaatttatgggaagatgggactacaaagtccatgctgttggtccgtggaacgtccatgctaggattcatagccaattttttagcctctattttaaccttcaaagcatggatcaccgaccataaagtagcaacaatgaacgcttcagggatgattgtcgtcgtttacataataaacgccattttcttattcgttttcgttatttgtcaattactggtatccctattggtagttcgaaacttatgggtcacaggagctatctttttggggctatttttctttgtagcaggccaggtattggtttatgccttctctacacaaatttgtgaagggttcaagcactacttagatggcctcttttttggaagcatctgtaatgtgttcacattaatgatggtttacaagacttgggatatgactaccgacgacgacttggaatttggtgtaagtgttagcaaggacggtgacgtggtgtatgataatggatttatgtga

SEQ ID NO: 402 - DNA, 1722 bp, Saccharomyces cerevisiae
atgggtgtttctgcggtgttgaaaagagctaggaatttactagcaacgttcatagtctgctgttttatggcagtagtgcttgttctggcgctggcacaccattttataaatgagcacagagacactaggagttcatcgacccaaatcgaagttgatgacgaaagtaaaagaaacgtacaccatgaccatgttctcactagaaccaatgcatacgcgacgccatacctcgatctggaacatgacaagaaaaacggtatcgtctacgatcatacaagaacggttgtccgtaaaaagaaccacgaagtggggtcctcgtcactgcataaaaacctttttcacaaatttttgacaaagcttatttttaggtttatcgagaaggaaaaagttaccgaaggcgtaacgcaaggaaagttcaataatagtagcaatgaaattgccaatcatgaaccggtttttgaaaaaattcctgtacagtgcgacaatccattacagaatctaatcttatcggaagacttgacattagttgcggatcttaattattattttaaccagtacaatattcaaatagaggaatttagattggagaccgaagatgggtttgttatagatttgtggcacttgataccaaaatatagaacgacagattctgacaagaagaagaggccacccattttgatgctacatggccttttgcaaagcagtggttcgttcgcatccaatggtagaaaatctctggcatattttctgtatcaatccggttacgacatatggttagggaataacagatgcgggtttaggccggaatggaacgaagcgaaagtaccgacactagcttccaggtgggactgggaccttcgcgagatggttaagtacgatctgacccttttgattgataccgtgttagctaagacgcagtttgaaaagcttactttgatctcgcattctcagggcactacacaggggtttatgggcttggtcaacgaagataagtttttccctcccggttcgggatctaaagaatcttttttcacttctaagatcgcaaactatattgccttggcccccgcagtgtatcctggtcccttacttaacgagaaattgtttgttaagcttatgacaaaggaaatcgaaaatccctggttctttggtgaaacgagcttttttgagataatgatgattgtaagaaacttgtgcgttggtgagagcttgttctcctttgtttgttacaccatcttcaattacctgtttgattggaacgataccctttgggataccgcattaagagatcgccatttcctgttttcgccagtccatgtttcagtgaagttgatgcaatggtggctgtcacccgaccccaacaaggtaagttttaaatttggttcccataagatgttccccgacaatgttaagtggttttcagacgcatcaaaggccccaaatatctacttgtttgttccaaagcaagatagattggtggacggagaaagactaatcaatcatttcgtcaatgtggagtcgaatgtcaactacaagatctggtacattgatgagtatgcccatattgatgtcctatgggcacatgatgtcatagagagaattggtaaaccaattttacagaatttgaacaactattactccaagaagccatccagcgcctttgaaagtgattgttcggacacagaggtggaaacggagctggaaatggttgctgagaaggcttga

SEQ ID NO: 403 - DNA, 1008 bp, Saccharomyces cerevisiae
atgcactcacaccattcacactccggtgactatagtgcccacggtacggaccctttggattccgtggtcgatcaagtggtcaacctcaactttcacacgtactgtttgacagagcacataccaagaattgaggccaagtttatataccccgaagagcagtcattgggcaagaatcctgaggaagtcataaccaagctagaaacatcgttcaagaatttcatgagtcatgcgcaagaaatcaagactcgttatgctgatagacccgatgtgcggactaaattcattataggaatggagatcgaaagttgtgacatggctcatatcgaatatgcaaagcgactcatgaaggagaataatgatattttgaagttttgtgtgggttcggtccatcacgtcaacgggatccctattgatttcgaccaacaacaatggtacaattcattgcattccttcaatgataatttgaaacattttctcctgtcttacttccaatcacagtacgaaatgctgatcaatattaaaccgttggtcgtgggtcacttcgacctttacaaattatttttgcccaatgacatgctagtaaaccagaaatcgggcaactgcaacgaagaaaccggagttcctgtagcttcactggacgtcatcagtgaatggccagaaatatacgatgcagttgtaagaaatttacaatttatagactcctatggcggcgcaattgaaatcaatacgtccgcattaagaaagcgcctcgaggagccgtaccccagcaaaaccttatgtaatctggtcaagaagcactgtggatccagatttgttctaagtgatgacgcacacggcgtggcgcaagtgggtgtgtgctatgacaaggtaaagaaatacatagtagacgtgctacaattagagtatatttgctaccttgaggaaagccaatcaccagagaatctgttaactgtaaagagattacccatttcgcaattcgttaatgatcccttttgggccaatatataa

SEQ ID NO: 404 - DNA, 2964 bp, Saccharomyces cerevisiae
atgcaatctcaagattcatgctacggtgttgcattcagatctatcatcacaaatgatgaagctttattcaagaagaccattcacttttatcacactctaggatttgcaactgtgaaagatttcaacaaattcaaacatggtgaaaatagcttactatcttcagggacttcccaagattccttgagagaagtttggttagaatctttcaagttgagtgaggttgatgcttctgggttccgtataccacaacaagaagctactaacaaggctcaaagtcaaggtgctctattaaagattcgtttagtgatgtctgctccaatcgatgaaactttcgacaccaacgaaaccgccacaatcacttatttctctactgatttgaacaagattgtcgagaaattcccaaaacaagccgaaaaattgtccgataccttagtgtttttgaaagatccaatgggcaacaacatcaccttctcaggcttagctaatgcaaccgattccgctccaacttccaaagatgctttcttagaagctacctccgaagacgaaatcatctctagagcttcttccgatgcttctgacttactaagacaaacattgggctcttctcaaaagaagaagaagattgctgtcatgacttctggtggtgattctccaggtatgaatgccgctgttcgtgccgttgttcgtacaggtatacatttcggctgtgatgtttttgctgtttacgaaggttacgaaggtttactaagaggcggtaaatatttaaagaaaatggcttgggaagatgtcagaggttggttaagtgaaggtggtactttgattggtactgctcgttctatggaattcagaaagcgtgagggtcgtagacaagctgcaggcaatttaatttcgcaaggtattgacgctttggttgtttgtggtggtgatggttctttaaccggtgctgatcttttcagacacgaatggccatctttggttgatgaattggttgcagaaggtagattcactaaagaagaagtcgccccatacaagaatttgtccattgttggtcttgtcggttccatcgataatgatatgtctggtactgactctaccattggtgcttattctgctttggaaagaatctgtgaaatggttgactacattgatgccaccgctaaatcccactcccgtgcctttgttgttgaagttatgggtagacattgtggttggttggccttgatggctggtattgctaccggtgccgattacatttttattccagaaagagctgttcctcacggaaaatggcaggacgaattgaaggaagtgtgccaaagacacagaagtaagggtagaagaaataacacaattattgtcgctgaaggtgctttagatgatcaattaaaccctgttactgccaatgacgtcaaagatgctttgattgaattgggtctagacaccaaggtaaccattctaggtcacgttcaaagaggtggtacagctgttgctcatgacagatggttagctactctacaaggtgtcgatgctgttaaggccgttctggaatttacccctgaaactccttctccattaattggtattttagaaaacaagataattagaatgccattggttgaatctgtgaagttgactaaatctgttgccactgccattgaaaacaaagatttcgataaggcaatttctttaagagacacagaatttattgaactttacgaaaacttcttatccactaccgttaaagatgatggttccgaattattgccagtatctgacagactaaacattggtattgtccatgttggtgccccatctgctgctttgaacgctgccacccgtgccgcaactctatactgtttgtctcacggccataaaccatacgctatcatgaatggtttcagtggattgattcaaaccggtgaagtgaaggaactatcatggattgatgtcgaaaactggcataacttgggtggttccgaaatcggtacgaacagatctgttgcttcagaagatttgggtaccattgcttactacttccaaaagaacaagctagacggtttgattattcttggtggttttgaaggtttcaggtccttgaagcaattgcgtgacggtagaacccaacacccaatctttaacattccaatgtgtttgattccagccactgtttctaacaacgttccaggtactgaatactcacttggtgttgatacctgtttgaacgcattagtcaattacactgatgacatcaaacagagtgcttctgcgacaagaagaagagtcttcgtctgtgaagtccaaggtggtcactctggttacatcgcttctttcactggtttaatcactggtgctgtttcagtgtacactccagaaaagaagatcgacttagcttctatcagagaagatataactctattaaaagagaactttcgtcacgacaaaggtgaaaacagaaacggtaagctattggttagaaacgaacaagcttctagcgtatatagcactcaattgttggctgacatcatctctgaagcaagcaagggtaagtttggtgttagaactgctatcccaggccatgttcaacaaggtggtgttccatcttctaaagaccgtgtcaccgcttccagatttgctgtcaaatgtatcaagtttatcgaacaatggaacaagaaaaatgaagcttctccaaacactgacgctaaggttttgagattcaagttcgatactcacggtgaaaaggtaccaactgttgagcacgaagatgactctgctgctgttatctgtgttaatggttctcacgtttccttcaagccaattgctaacctttgggaaaacgaaaccaacgttgaattaagaaagggttttgaagttcactgggctgaatacaacaagattggtgacatcctgtccggtagattaaagttgagagctgaggtagccgctttagccgctgaaaacaaatga

SEQ ID NO: 405 - DNA, 1371 bp, Saccharomyces cerevisiae
atgtcatttcgtaaaagaggtgaaatactgaacgatagaggtagcgggctaagaggtccactgttaagaggtcctccacgaacttcctcaacgccattgaggacaggcaacagaagagcccctggaaatgtgcccttgtctgacactacagcgagattaaagaagttgaatattgcggacgaatccaagacaaaaatggggctggatagctcccatgtgggcgttagaccttctcctgcaacctctcagccgacgacatcaactgggagtgctgacctggacagtatactaggccatatggggctgccgctgggaaactctgtactagtagaggagcagagcacgacagaatttcactctattctcggtaaactgtttgccgcacagggtatcgttcataatagaatttcagatagcagtgctgataaaactagaaacggcgacactcatgtcattgtcttgtcattgaaccaaatgtttgcaaaggagctacctggtatctacaagggatcacgtaaacaaatgaagaaaaacctaatctctgaagaagaatcaaaagttactgttcaaaatttgaacgagacccagagatcgacgccttccaggtacaaagacctgaaaattgcatggaaatataaactggcagatgaaaagagattgggttctccggatcgagatgacatccaacaaaattctgagtacaaggactacaatcatcagtttgatattacaacgcgtctgatgcccgctcccatagcatctgaactgacatttatcgccccaactcaacctgtctccactattttgagccaaatagaacagactattaaaaggaatgacaagaaactgataagaattgttattccttcccttctacatccggcaatgtatccgcccaaaatgtttgaatcatctgaaataataggtttaatgcacggtgtgaggagtcttgtcaagaaatactatgagcgggttgtactgtttgcttccatatccatagacattatcactcccccattactggtattgctgagaaacatgttcgattctgttatcaatctagaaccctttaaccaggagatgactgagttcttagaacgtgtttataaatcgcaaccggggaagattcaacatgggctagtccacatattgaaattaccagttttcacggaccgtggagagatgagagttttaaagtctgaatgggcatttaagaatggcagaaaaaagtttgaaatagaacaatggggcatacccgtggatgatgctgaaggttcagctgcctcggaacagtcacattcacactcgcactcggatgaaatctcacataatatacctgcaaagaagaccaagatatctttagactattaa

SEQ ID NO: 406 - DNA, 3024 bp, Saccharomyces cerevisiae
atggcatcaactgctcccaatgaacaatttccatcctgcgtacgatgcaaagaatttattaccacggggcatgcatatgagttgggttgtgatagatggcacacacattgtttcgcttgttacaaatgtgagaaaccattaagctgcgaatctgattttttagtccttggaacaggtgctttgatctgctttgattgttccgattcttgtaaaaattgcggtaaaaagattgatgatttggccataatactgtcctcttcaaatgaggcctattgttcagattgttttaaatgctgtaaatgtggtgaaaatattgctgacctacggtacgcgaaaaccaagcgaggtttattctgtttaagctgtcacgaaaagctattagccaaacgaaaatactacgaagagaagaaaaggcgactcaaaaagaatttaccaagtttacccacacctgtgattgataatggccatactgatgaggtctcagcttctgcagtcctcccagaaaaaacatttagcagacctgcatcactagttaatgagattccttcaggttctgaaccttccaaggacatagaaaccaattcgagtgatattgttccgcattttatcactgggtataacgatagcgatgacaactctggaagttcaaaattcggttcaaatgtgtccatagatgttataggaccggaagaaaatagcacggagcatgtaaatgatgatgttaaagaggaagcagaagcaccttcagcgaatatgtcactcaatgttgctacggatccaaccctaagttgtaaagaacctcctagccattcgaggaatttgttaaataaaacaccgttgagaaattcttcgggtcagtatctcgcaaaatctccaagctcctatagacagggaataattgttaacgatagtctggaagagagcgatcaaattgatcctccaaataacagttcacgaaatgcaagtgaattgttgacctcggtattgcatagcccagtttctgttaatatgaaaaatccgaagggttcaaatacggatattttcaacaccggtgaaatatcccaaatggatccttcgctatcaaggaaagtattgaataatattgtcgaagaaacaaacgcacttcaaaggccagttgttgaagttgtcaaggaagacagaagtgttcctgacctagcaggtgttcagcaagagcaagcagagaaatattcctattcaaacaatagtggaaaaggcagaaaaatttcaagatcattgtcacgaaggtccaaagatttgatgattaatctaaaatccagagccacaggcaaacaggatagtaacgttaaactttcacctgcttctaaagtgacatctagacgctcacaagatttaatgagggataatgattcacataccggccttgacacaccaaattctaacagcacttctttagatattttggtgaataatcaaaaaagcctaaactataaaagatttaccgataatggcactcttagggtgactagtggaaaggaaaccgcccttgaagaacagaagaatcacagttttaaatctccgtcaccaattgatcatttgttacaatcgccagctacaccaagtaatgtatccatgtatcgaactccgcctttagatagctcattgacatttgataggcggaatgggtcttcatacagtaaccaaaattatagcatacctagttggcagaaaactccaaagacccaattggagaatagcgacaattttgaggaacagaaggaaacactttacgaaaatagcgaatctagaaacgatccctcgcttgataaagaaattgtcacggcagagcactatctgaagcaattaaaaataaatttgaaagaacttgaatctcaaagggaagaattaatgaaagagatcactgaaatgaagtctatgaaagaggctctacgccgacatattgaatcctataatagcgagaaaaataaactatatcttgactccaatgaattatcaaataatccaccgatgataaatgaaatcagcttaggtgagtcgccacccgtgaaacatgttgcaactgcaagttctgtagcgcgaagttctgttaaaccaaaattttggaagtttttttcatctgcaaagccacagaccgagcaatctatacaaggtgtcagtacaaataatacaaattccatcgttaaaagtgccccagttttgctttctgctccctcatctggtagtaattccggccgtttagaaatttcaccacctgtgctacaaaatcctaatgaatttagtgacgttagattagtacctatcgagaacgatgcaaatatgggacaaagtaaagatggagaagaatatttggatggaagcaatttgtatggttcaagtctcgttgctaggtgcaattatgaaaacaatgaaataccgatgatactatctgtctgcatagattttattgaatcagacgaagaaaatatgagatcggagggcatttatagaaaatcaggttcccagctagtcatagaagaaatagaaaagcaattttctgcatggaaagtacaacaaaataccgaaacgccaaatattttaacggaacaagatctcaacgttgttactggtgtgttgaagcgatacttaagaaagctccccaaccctatctttacctttcaaatatacgagccgttgatgaggttagttaaatctaaaaaaatgatggaaaacttgccatttgttggaggaaagttgtccttagaagcaaagaattcggacacttatatgtcgagcaagagcgctttaaaaaacatattggaagaccttccaagggaacattatagggtgttaagagtactgagtgaacatatagaaaaggttacacggtacagtcactggaatcgaatgacgctttataatttggctttagtttttgctccaggtttgattcgtgatttcagtggagaaaaggatattattgatatgaaagaaagaaactatattgtcgcatttatatttgggaactacaaagatatcctgacgtag

SEQ ID NO: 407 - DNA, 777 bp, Saccharomyces cerevisiae
atgttagaagcaaaatttgaagaagcatcccttttcaagagaataattgatggtttcaaagattgtgtccagttggtcaatttccaatgtaaagaagatggtatcattgcacaagctgtcgatgactcaagagttctattggtctccttggaaataggtgtcgaagccttccaagaatatagatgtgaccatcctgttacgttaggtatggatctaacctcactaagtaaaatcctacgttgtggtaacaacaccgatacattaacactaattgctgacaacacaccggattccatcatcttattatttgaggataccaagaaagaccgtatagccgaatactctctgaaattgatggatatcgatgctgatttcttaaagattgaagaattacagtacgactccaccctgtcattgccatcttccgaattctctaaaattgttcgtgacttgtcccaattgagtgattctattaatatcatgatcaccaaagaaacaataaagtttgtagctgacggtgatatcggatcaggttcagtcataataaaaccattcgtggatatggaacatcctgaaacaagcatcaaacttgaaatggatcaacctgtcgacttgacgttcggagctaaatatttattggacatcattaagggctcctccctttctgatagagttggtatcaggctctccagcgaagctcctgctttattccaatttgatttgaagagtgggttcctacagtttttcttggctcctaaatttaatgacgaagaataa

SEQ ID NO: 408 - DNA, 3651 bp, Saccharomyces cerevisiae
atgaagccggaaaaactcttctccggtttaggtaccagcgatggcgagtatggagtggtaaatagcgagaacatatcaatagatgctatgcaagataatagaggcgagtgtcatcgtagatccatagaaatgcatgctaatgacaatctgggattggtctcccagcgagactgtaccaatcggcccaaaattactcctcaggaatgtttgagtgagactgagcagatatgccatcatggcgagaataggactaaggctgggttagatgtagacgatgctgaaaccggtggtgatcacaccaatgaatcccgtgtagatgaatgttgtgctgagaaagtgaacgacactgagactggcttggatgtggacagctgttgcggcgatgctcaaacaggtggtgaccacaccaatgaatcctgtgttgatggatgctgcgttagagattcttcagtgatggtcgaggaagttacaggcagctgcgaagctgtatcttctaaagaacaattgctgaccagctttgaagttgttccaagcaaatctgaaggtctgcaatctattcatgatattagagagacaactcgctgcaataccaattccaaccaacacacagggaagggtaggctttgcatcgaatcaagtgactctacactcaagaaaagaagttgtaaagttagcagacagaaaattgaggtttccagtaagcctgagtgctgcaacatttcatgtgttgagcggattgcatctcgtagctgtgaaaagaggacttttaaaggtagcaccaatgttggaatttctgggagtagctctaccgacagtttaagcgagaagttcttcagcgaacagtactctagaatgtacaatcgttactcctcaattttgaaaaatttaggttgtatctgtaactatttgcgtactttgggaaaagaatcttgttgtctcccaaaggtgcgtttttgtagcggggagggtgcttctaaaaagacaaaatactcctaccgcaacagttctggatgtttaacaaagaaaaagacccatggagacaaagaaaggttgagcaatgacaatggccatgctgattttgtttgttctaaaagttgttgcactaaaatgaaggattgtgctgttacctcaactatttctggaacctcttcgagtgaaatttcaagaatcgtatcaatggaaccaattgaaaatcatcttaatcttgaggcaggatctaccggtaccgagcacattgttcttagtgtttcaggaatgtcctgtactggttgtgaatcaaaacttaagaaatcatttggcgcgctcaaatgtgttcacggtttgaagaccagtttaatattatcgcaagctgaatttaatctggatcttgctcagggatctgtcaaggatgttatcaagcacttgagcaaaactactgaattcaagtacgaacagatttcaaatcatggttcaactatagatgttgttgttccttatgcagcaaaagattttattaatgaggaatggccacaaggtgtcacagagctgaaaattgttgagagaaatatcattcgtatttactttgacccaaaggttataggtgccagagatcttgtcaatgaaggatggagcgtgcctgttagtattgctccattcagttgtcatccaaccattgaagtgggaaggaagcatttagttcgtgtaggctgcacgaccgctttatccataatattgacgatcccgattctcgtgatggcttgggctccacagcttcgtgaaaaaatttccactatctccgcgtcaatggtgctagcaactattattcaatttgttattgcaggaccgttttacttaaatgccttgaagagtttgatattttccaggctcattgaaatggatctactaatagttttaagcactagcgctgcctacatattttcgattgtatcatttggatatttcgttgttggacgcccgttatctacggagcagttttttgaaaccagctctttgcttgtaactctcatcatggttggtcgctttgtgagtgaactagctagacatagggctgtaaagtcaatatcagtacgttccttacaggcctcttctgctattctggtggataaaactggtaaagagacggaaattaatattagacttctccaatatggcgatatttttaaggttttacctgattcaagaatcccaactgatggaacagtcatttctgggtcttctgaagtcgacgaagcgttaatcacaggtgaatctatgccagtcccgaaaaagtgtcaatcaattgttgttgcaggatcggtgaatggcactggtactttgtttgtgaagctgagcaagcttccagggaacaatactattagtaccatagccacgatggttgatgaagcaaaattaactaagccaaagatccaaaatatcgctgataaaattgcaagttatttcgtgccaactatcattggaatcactgtcgtcaccttttgcgtttggatagcggttggaatccgtgtggaaaagcaatcccgctccgatgccgtaattcaggccattatatatgccattacggtacttatcgtttcgtgtccctgcgtgattggacttgccgttcctatcgtatttgttattgcaagtggcgtcgctgcgaaaagaggggtaatcttcaaatcagcagagagtatagaagttgctcacaacacttcgcatgttgtcttcgataaaacgggtaccctaactgaaggaaaacttactgtagtacatgaaactgttaggggtgatcgtcataattctcaatctttgttgcttggattaactgaaggaataaaacacccagtttccatggcaatagcatcctatctcaaagaaaaaggtgtttctgctcaaaatgtttctaatacaaaagctgtgactggtaagcgggtagaaggaacatcatactctggtttgaagttacaaggagggaactgtcgttggcttggtcataacaatgatcctgacgttcgaaaagcccttgaacaaggatattctgtattctgttttagtgttaatggttcagtcactgcagtttatgcattagaggactctttacgggcagatgctgtctccactattaacttgttacgccaaagagggatttcactacacattttatcaggggatgacgatggagccgttcgttctatggcagcccgtcttggaattgaaagctccaatattcgttctcacgcaacgcctgcagaaaagagtgaatatattaaggatattgtcgaaggaagaaattgcgatagttcttcgcagtcaaaaagaccggttgttgttttttgcggtgacggaacaaacgacgcaattggtttgactcaagcaacgattggagttcatatcaatgagggaagtgaggttgccaagctagctgctgatgtagttatgttaaagccaaagctcaacaatattttgactatgataactgtaagtcaaaaggccatgtttagggtcaaattgaatttcttatggagttttacttacaacttatttgctatccttttggcggctggtgcctttgttgactttcatattccaccagagtatgcgggtttaggggaactagttagtatcctccctgtaatttttgtagctatacttctgcgttatgcaaagatttag

SEQ ID NO: 409 - DNA, 1254 bp, Saccharomyces cerevisiae
atggctgtatttactcctccatcaggtaatagcaattccaccgaccatactcacacacaagatgaccacgacaaagatgataatgatatcaagaaattctacataaggccaagtttaggcttaaaactgtggggtccgctcgtacccgctcctgataacctaccgggactatacactctaatcactatccaatctgcagtgggtttctttgccctttggagactgagaaggctctacaaactaccgccaccgcgccgcattgccactggcactcactcggatttatcctttggcgaactacccagtgaaatgattgtcaatggcaagactaaaatcaaaaaggatattgctgactttccaactttgaaccgcttctccaccacccatggtgacattgtgctcgcccctcctcccatcatacctcgccaatctcgattcgtcagcgtcagaaagctcttatgggggttgtttggctctttgctactttctcagtcactgttggagcttactcgcctgaactttcttaaatacgacccctggtgcgacgaaatgaaatccgtacgtgacaagaagtttttcaacaatattgtcaaatattatcacgagggcatagaccccaccaaaataaaagtcaaggatgctatgaacggtactcctctctcgacaaatatccctgaggtcaaacaaagcgtcgctctcgctagagcgcaagttgaggcgcagaatcccattattaaatggttcggacccttggaatacaagcccatgtctttcaacgagtacctcaatcgcatggaatttcacttggacatgttcgagttttttcaaaataaaagaaacattagagaaaattccattgaactcatcaattccatatcccacaatccgcagtcttcttctactggccttgaaggtctttccgagtccaaaaaactccatctacaaaatgtggaaaaaagactgcatttcttagcatcttcgggagattccatttccgcaccagtaaagaagagatccagcaccacactctcccgaggtgtcattttgccccatgacacgaaaggcccgcaagatattgatctcgatacaataagatcgctttatgatccatggatgactttggccttagaaacttcgctaagcatcaaattcataccaactaccatgccctcccataccaagacacccactagcacggaccagccgttaccagggcctacccccaaggctctcactaatgaaaagacacattag

SEQ ID NO: 410 - DNA, 1350 bp, Saccharomyces cerevisiae
atgtttttggaaattcctcggtggttacttgccttaataatattatacctttccataccgttagtggtttattatgttataccctacttgttttatggcaacaagtcgaccaaaaaaaggatcatcatatttgtgctgggtgatgtaggacactctccaaggatatgctatcacgctataagtttcagtaagttaggttggcaagtcgagctatgcggttatgtggaggacactctacccaaaattatttccagtgatccaaatatcaccgtccatcatatgtcaaacttgaaaagaaagggaggcggaacatcagttatatttatggtaaagaaggtgctttttcaagttttaagtattttcaaattactttgggaattgagaggaagcgattacatactagttcaaaatccaccgagcatacccattcttccgattgctgtgctatacaagttgaccggttgtaaactaattattgattggcacaatctagcatattcgatattgcaactaaaatttaaaggaaacttttaccatcctttagtgttgatatcttacatggtagagatgatattcagcaaatttgctgattataacttgactgttactgaagcaatgaggaaatatttaattcaaagctttcacttgaatccaaagagatgtgctgttctctacgaccgcccggcttcccaatttcaacctttggcaggtgacatttctcgtcaaaaagccctaactaccaaagcctttataaagaattatattcgcgatgattttgatacagaaaaaggcgataaaattattgtgacttcaacatcattcacccctgatgaagatattggtattttattaggtgccctaaagatttacgaaaactcttatgtcaaatttgattcaagtttgcctaagatcttgtgttttataacgggtaaaggaccactaaaggagaaatatatgaagcaagtagaagaatatgactggaagcgctgtcaaatcgaatttgtgtggttgtcagcagaggattacccaaagttattacaattatgcgattacggagtttccctgcatacttcaagttcagggttggacctgccaatgaaaattttagatatgtttggctcaggtcttcctgttattgcaatgaactatccagtgcttgacgaattagtacaacacaatgtaaatgggttaaaatttgttgatagaagggagcttcatgaatctctgatttttgctatgaaagatgctgatttataccaaaaattgaagaaaaatgtaacgcaggaagctgagaacagatggcaatcaaattgggaacgaacaatgagagatttgaagctaattcattga

SEQ ID NO: 411 - DNA, 1491 bp, Saccharomyces cerevisiae
atgtctgctgttaacgttgcacctgaattgattaatgccgacaacacaattacctacgatgcgattgtcatcggtgctggtgttatcggtccatgtgttgctactggtctagcaagaaagggtaagaaagttcttatcgtagaacgtgactgggctatgcctgatagaattgttggtgaattgatgcaaccaggtggtgttagagcattgagaagtctgggtatgattcaatctatcaacaacatcgaagcatatcctgttaccggttataccgtctttttcaacggcgaacaagttgatattccatacccttacaaggccgatatccctaaagttgaaaaattgaaggacttggtcaaagatggtaatgacaaggtcttggaagacagcactattcacatcaaggattacgaagatgatgaaagagaaaggggtgttgcttttgttcatggtagattcttgaacaacttgagaaacattactgctcaagagccaaatgttactagagtgcaaggtaactgtattgagatattgaaggatgaaaagaatgaggttgttggtgccaaggttgacattgatggccgtggcaaggtggaattcaaagcccacttgacatttatctgtgacggtatcttttcacgtttcagaaaggaattgcacccagaccatgttccaactgtcggttcttcgtttgtcggtatgtctttgttcaatgctaagaatcctgctcctatgcacggtcacgttattcttggtagtgatcatatgccaatcttggtttaccaaatcagtccagaagaaacaagaatcctttgtgcttacaactctccaaaggtcccagctgatatcaagagttggatgattaaggatgtccaacctttcattccaaagagtctacgtccttcatttgatgaagccgtcagccaaggtaaatttagagctatgccaaactcctacttgccagctagacaaaacgacgtcactggtatgtgtgttatcggtgacgctctaaatatgagacatccattgactggtggtggtatgactgtcggtttgcatgatgttgtcttgttgattaagaaaataggtgacctagacttcagcgaccgtgaaaaggttttggatgaattactagactaccatttcgaaagaaagagttacgattccgttattaacgttttgtcagtggctttgtattctttgttcgctgctgacagcgataacttgaaggcattacaaaaaggttgtttcaaatatttccaaagaggtggcgattgtgtcaacaaacccgttgaatttctgtctggtgtcttgccaaagcctttgcaattgaccagggttttcttcgctgtcgctttttacaccatttacttgaacatggaagaacgtggtttcttgggattaccaatggctttattggaaggtattatgattttgatcacagctattagagtattcaccccatttttgtttggtgagttgattggttaa

SEQ ID NO: 412 - DNA, 1431 bp, Saccharomyces cerevisiae
atgagttttagaaggattaactctagatactttgaaaatagaaaaggaagcagtatggaagaaaaaaaagcaaaggttcctccaaacgtcaacctttcgttatggagaaagaacacggtagaaagcgatgtccatcgattcaattctcttccatcaaaaattagtggggccctaactagggaacaaatatactcctatcaagtcatgtttaggattcaagaaattaccatcaaactgcgtacgaacgattttgtgcccccctccaggaaaaataggtcaccttctccgccaccagtttatgatgcccaaggtaaaagaacgaatacccgtgagcagaggtatagaaagaaactagaggatgaacgtattaaacttgttgagatagccctaaagaccatcccttacttcgttcctccggatgattacaagagacctaccaaatttcaggacaagtattatatcccggtggatcagtatcctgatgtcaattttgttggtttattattaggtcctcgtggacgtacgttaagaaagctgcaagaagattcgaattgtaagattgcaattagaggaagaggttcagtcaaagaaggtaagaatgcaagtgacttacctccaggcgccatgaactttgaggaccccttgcactgtttaattatcgcagactcggaagacaagatccaaaaaggtataaaagtttgtcaaaacattgttatcaaagcggtgacatctccggaaggccagaatgacttgaaacgaggacaactgagagaattggcggaacttaatggtactttaagagaagataacaggccctgtccaatctgtggtttaaaagatcataaaaggtacgattgtccaaacagaaaaatcccaaatatacagggcattgtttgcaaaatatgtggacaaactggacatttcagtagagactgtaactcatcgtctcaaagaatgagccgttttgacagaaacgccacggtaaataattctgcgccaatacagagcaatgacgtacactataatagcaatactcatccaattcaagcaccaaaaagatctcgttatgacaataactcgacggaacctcctttaaaatttccggcttcttcacgttatgcaccatcaccttcacctcctgcgtcacatatttcgaggcaagctcaaaacgtgacgcctacaccccctcccggcctaacatcaagtagctttagttccggagttccaggaatcgcccctcccccattacaaagccctccagagtcggaacaaccgaaattttcgctacctccacctcccggtatgactacggtacaatcctcaattgcacctcctcctggcctaagcggtcctccagggttttctaataacatgggcaatgacattaacaaacctacacctccgggactgcaagggcctcccggattataa

SEQ ID NO: 413 - DNA, 1290 bp, Saccharomyces cerevisiae
atgttgcataaaagcccttcaagaaagagatttgcttctcctttgcatctaggatgcattctaacgcttacagtgctctgccttattgcttactactttgctttaccggattatttatcggtagggaagagctcatccaggggtgccatggatcaaaaatctgatggaacctttagacttaagtctatctacaggcatggcgtcggagcaaaccatcggctacaccagaggctggaggtcactccagaagttatttctgccgctggaatgctgtatcaagaaaccacaactcaaggacaggatttcgaagaccaagaacccctatggactactaatgccgaatatgccaccactaacccattcgattttgagtttgagctacgaaggatgccgctattgatgaagcggatgaaggaaagagatcctgaattcatagagtcgtacatttacggagaaacatacatgacggaggaggaagaacacgccatgtggatagatgatgacattgtggcacccaatatcacagatagaggtacagtagtgtcgttagcattaatgtcgtctaatgcttacgtgagaataccgcaaacgggagactggcgtaacgtcacggagccgtggaatgaaacagagccggaagattttggttgggatggtgatggtatacgtggtcacgtcttttacaatgaagtggagaatatcgtggtactctcgataaagggaaccagcgctcagggtttgccagggtctggcgaagatgagacaactggaaacgacaagatcaacgataatttgttattttcgtgttgttgtgcaagagtgagctacctgtggactaccgtgtgcgattgctatgtgaagtcgtatatatgcgatgagtcttgcctggaaaaggaactgagacgtaaggatagattttactctgcagtcgttgacatatacaaaggcgtcctcaaagaatacccgatgcggccatatgggtcacaggccactcactgggaggcgcattggccagtttactgggccgcacttttggattgcctgcggtcgcattcgagtcccctggagagctactaccttcaaaaagacttcacttaccattcccaccgggacttccctcatacatggagggtatctggcacttcggtcacaacgcagacccaatcttcatgggtacatgcaacggagctagttcaagttgctcactggtgggctacgctatggaaaccgcgtgccacactggtagagtctgtgtctacgatgtggtcaacgacaagggctggagtgtaa

SEQ ID NO: 414 - DNA, 1023 bp, Saccharomyces cerevisiae
atgaccgcaccattggtagtattgggtaacccacttttagatttccaagccgacgtcacggctgaatacctggccaagtattctctaaaggaaaacgacgcaattttggtcgatgccaaatcaggcgatgctaagatggctatttttgacgagctcttacagatgccagaaacaaagcttgttgcaggtggtgctgctcaaaacactgctagaggggcagcatacgttttgggcgccggccaggtggtgtacttcggttccgtcggtaaggacaagttcagcgagagattgcttaacgaaaacgaaaaagctggtgtcaagtctatgtaccaagttcaaaatgatattggtaccggtaagtgtgccgcattaatcactggccataaccggtccttggtcactgacttgggtgctgccaatttctttactccagaccacttggacaagcattgggacttggtcgaagcagctaagctcttctacatcggtggtttccacttgaccgtgtctccagacgctatcgttaagttgggccaacatgctaaagagaacagcaaacctttcgtgttgaactttagtgctcctttcattcctcatgtcttcaaagacgcattggccagagttttgccttatgctaccgtcatcatcgctaacgaatcggaggccgaagccttttgcgacgccttccaattagactgtgccaacactgatttggaagctattgctcaaagaattgtcaaggactctccagttgaaaagactgtcatcttcacccacggtgtcgaaccaacagtggtcgtgtcctccaagggtaccagcacatatccagtcaaacctttggactcttctaagatcgtcgacaccaacggtgctggtgacgccttcgctggtggctttatggctgggttgactaaaggtgaagatttggaaacctctattgacatgggtcaatggctagctgctttgtctattcaagaagttggtccctcttacccttccgaaaaaatatcttactctaaatag

SEQ ID NO: 415 - DNA, 2535 bp, Saccharomyces cerevisiae
atgaccagtaaaaccccaaatcgtgaaattcttcctgataatgtcgttcctttacactacgatttaaccgtggaacctgatttcaaaacattcaaatttgaaggctcagtcaaaattgagctaaaaattaataatcctgcaattgatacggtaacattgaacaccgtcgataccgacatccattctgcaaaaatcggtgatgtcacatcttccgagattatctctgaagaggagcaacaagtcaccacatttgcgtttcctaaagggaccatgtcttctttcaagggtaatgcatttttggatataaaatttactggtattttaaatgataatatggctggcttttacagagccaaatatgaggacaagttaacaggtgagacaaaatacatggctactactcagatggaacctactgatgctagaagggccttcccatgttttgatgagcctaacttgaaagcctcttttgctattactttagtttcagacccatctttgacacacctatccaatatggacgtcaagaacgaatacgtaaaggatggaaaaaaggtcactttgttcaatacgacccctaaaatgtcaacttaccttgttgcttttattgttgctgaattgaagtacgttgaatccaagaactttcgtattcctgtcagagtttacgccaccccaggtaacgaaaaacatggtcagtttgccgcggatttgactgccaagactttggcattttttgaaaaaacttttggcatccaatatcctctacctaaaatggacaatgttgctgttcacgaattttctgcaggagctatggaaaattgggggttagtcacttatagagtggttgatctactactagacaaagataactctacattagatcgtattcaaagagtggctgaggtagttcaacatgaattagctcaccaatggtttggtaacttagttactatggactggtgggaaggcttatggctaaatgaaggttttgctacttggatgtcatggtattcatgtaatgagtttcaaccagaatggaaagtttgggaacagtatgttactgataccttacaacatgcattaagccttgactctttaaggtcctctcatccgatcgaagtacctgtaaaaaaagctgacgaaattaaccaaatctttgatgccatctcttactcaaagggtgcttctttattaaggatgatttcgaaatggttaggtgaagaaacttttattaaaggtgtatcccaatacctgaataaatttaaatacggtaatgcgaagactgaagacctatgggatgctttagcggacgcctccggtaaagacgttcgttctgtgatgaacatctggactaaaaaagttggtttcccagtcatttcagttagcgaagatggtaacggtaaaataacatttcgccaaaaccgttacttaagcacagctgatgtcaagcccgacgaggacaaaaccatctatcctgtatttttggctttgaagactaaaaatggagttgacagttccgttgtattgagtgaaagaagcaaaactattgaattagaagatcctacctttttcaaagttaacagcgaacaatccggaatttatataacatcctacaccgatgaaagatgggcaaaactgggtcaacaagctgacttattgtctgttgaggaccgtgtcggtctggttgctgatgtcaagacactatctgcttctggctacacttcaactactaattttttgaacttagtctccaaatggaataatgaaaagtcatttgtcgtctgggaccaaataatcaacagcatatcttcaatgaaatctacttggttattcgaaccaaaggaaacccaggatgcgcttgataacttcacgaagcaactaataagcggtatgacacaccacttgggttgggaattcaaatcttctgattcgttctccactcaacgtttgaaagtgaccatgtttggtgctgcttgtgccgcaagggacgcagacgttgaaaaagctgctctaaaaatgtttactgattattgcagcggtaataaggaagccatcccagcattgattaaaccaattgtatttaacactgtggcaagagttggtggtgcagaaaactatgaaaaagtttacaaaatctacttagatccaatctctaacgatgaaaaattagccgcattaagatctttaggcagatttaaagaacctaaattattagaaagaaccttaggatatttgtttgatggcactgtcttaaaccaagacatttatattccaatgcaaggaatgagagctcatcaagaaggtgtagaggctttgtggaattgggttaaaaagaactgggacgaactcgtaaagagactacctcctggtctttcaatgctaggctccgtcgtcacattaggtacctctggctttacatcaatgcaaaaaatagatgagattaagaaattctttgccactaaatccacgaaaggtttcgatcaaagtttggctcaatcactggacactattacttcgaaagcgcagtggggttaa

SEQ ID NO: 416 - DNA, 2259 bp, Saccharomyces cerevisiae
atggcaagcatcggttcgcaagtgagaaaagctgcttctagtattgaccctatcgtcacggattacgcagtgggctactttaaccacttgtccggaataacttttgatgctgttcaaagtaagcaggtagatttgtccactgaagtgcaatttgtgtccgatttattgattgatgcgggtgcgtcaaaggctaaagttaaagaactatcggaaagtattttgaagcaattgactactcaactaaaggagaacgaagccaaattggaattgaccggtgatacgtccaagagattacttgatattaatgtcttaaagagtcataacagtaaatccgatatcaacgtctcattaagcatgctgggtgtgaacggtgacatcgaacatactggtagaaagatggaaacaagagttgatttgaaaaaactggccaaggctgaacaaaagatcgcaaagaaagtcgccaagagaaataacaaatttgttaaatacgaggcttctaaattgatcaatgaccaaaaggaggaggattacgattctttctttttgcaaatcaaccctttagaattcggttcatccgctggtaaatccaaggatatccatattgacactttcgacttgtacgttggtgacggtcaaagaattttgtccaacgcccaattgactctaagttttggtcacagatatggtcttgtgggccaaaatggtattggtaaatctactttgttaagggctctatctagaagagagctgaacgtccccaaacatgtttcgattttacacgtggaacaagagttaagaggtgatgatacaaaggctttacaaagtgtgctggatgcagacgtttggagaaaacaactattaagtgaagaagccaagatcaatgaaagattaaaggaaatggatgtattaagacaggaattcgaagaagacagtttagaagttaaaaaattggacaatgaaagagaagacttggataaccatttgatacagatttctgacaaattagtcgatatggaatctgacaaggctgaagctagggcagcatcaatcttatatggtttggggttcagtacggaggcacagcaacaacccactaattccttttccggtggttggagaatgagattgtccttggcaagagccttattctgtcaaccagatcttttgttgttagatgaaccttccaatatgttggatgtgccatccatcgcttatttagcagagtatttgaaaacatatccaaatacagttttgacagtttctcacgaccgtgcattcttgaatgaagtggctacagatatcatttatcaacacaacgaaagactagactattacagaggccaagatttcgataccttttacaccacaaaggaggaacgtagaaagaatgctcaacgtgagtatgataaccaaatggtttacagaaagcacttgcaagagtttattgacaaatacagatacaatgctgccaaatcacaggaagctcaatcaagaattaagaaattggaaaaattgcccgttttggagccacctgaacaagacaaaaccattgatttcaaattccctgaatgtgataaattgtctccaccaattatccaattgcaagacgtttcctttggttatgatgaaaacaacctattattgaaagatgttaacctggacgttcaaatggattccagaattgcccttgtaggtgccaatggttgtggtaagactacactgttgaagattatgatggagcagttaagaccactaaaaggctttgtatcaagaaacccaagattacgtataggctacttcactcaacatcatgtggattctatggatttgaccacgtctgcagtggactggatgtccaaatccttcccaggtaaaactgatgaagagtatagacgtcatctaggttcatttggtatcactggtaccctgggtctacaaaagatgcaattattatccggtggtcaaaaatctcgtgtagcattcgctgcattgtgtttaaataatccacacattttggttctggatgaaccttctaaccatttggataccactggtctagacgctttggtagaagccttgaaaaatttcaacggtggtgtcttaatggtttcccatgatatctctgttattgactctgtttgtaaagagatttgggtttcagagcaaggtactgtcaagaggttcgaaggtacaatttacgactatagagattacatcttgcagtctgctgatgctgcaggtgtggttaaaaagcattga

SEQ ID NO: 417 - DNA, 2139 bp, Saccharomyces cerevisiae
atggctggaaaaaagggacaaaagaaaagtggactaggcaaccatggaaagaactctgatatggatgttgaagatcgtctccaggccgttgtcttgacagactcttatgaaactaggtttatgccactgacagctgtcaagccaaggtgtttgctgccactggctaacgtacctctcattgaatacaccttagaatttttggctaaggctggcgtacatgaagttttcttaatttgctcttctcatgccaaccaaattaatgactatattgagaattctaagtggaacttgccttggtctccatttaaaattaccaccattatgtctccagaagctagatgtacgggtgatgttatgagagatctagataatagaggtatcattactggagattttattttagtcagtggtgatgtattgactaacatcgatttcagcaaaatgctagaatttcacaaaaaaatgcatttgcaagataaagatcacatctcgacaatgtgtttgagcaaagcgagtacctatccaaaaacaagaactattgagcctgccgcatttgtcttagacaaatccaccagtaggtgtatttattaccaagatttaccattaccaagctctagagagaagacttccattcagattgacccagaattgttggataatgtcgatgaatttgtcataaggaatgacctcatcgattgtagaattgacatttgtacatctcatgtacctttgatatttcaagaaaattttgactaccaatcattaaggacagactttgttaaaggtgtcatttcaagcgatatattgggaaagcatatatatgcctatttgacggacgaatatgctgtaagagttgaaagttggcaaacttacgacaccatttctcaagactttttaggtagatggtgttatcccttggtcttagactctaacatacaggacgatcaaacgtattcttatgaatcaagacatatatacaaggaaaaagacgttgttttggcccaatcctgtaaaattggtaagtgcactgcaattggatcaggaacaaaaatcggagagggtacgaaaattgagaattccgtgattggaaggaactgccaaatcggtgaaaatattagaatcaagaacagtttcatttgggatgactgtatcatcggaaataacagtataattgaccattcattaattgcctctaatgccacgttagggagtaatgtacgcctaaatgatggctgtataattggtttcaacgttaaaattgatgataatatggatttagatagaaacacaaaaatatctgccagtccattaaaaaatgccggctcaagaatgtatgataatgaaagcaatgagcagtttgaccaagaccttgatgatcagacactagccgtttctattgttggagataagggtgttggttatatttacgaaagcgaggtgtctgacgatgaagatagttctacagaagcctgcaaagaaataaacactttgagtaaccaattagatgagttatacttaagtgacgattcaatttcttccgccactaaaaagacaaagaaaagaagaacgatgtctgtcaatagtatatacacggatagagaagaaattgattctgaatttgaggacgaagattttgagaaagaaggtattgccaccgtggagcgtgctatggaaaacaatcatgatcttgacacagcattattagaattgaacaccttgagaatgagtatgaacgtgacatatcatgaggtgagaatagcaacaataactgcattattgagaagagtttaccactttattgcaactcaaacattaggtcccaaggacgctgtggtgaaggtttttaatcagtggggactgttgttcaagagacaagcctttgatgaagaagagtatattgatttgatgaacatcataatggaaaaaattgtagaacagagttttgacaaaccggatttgattctatttagtgcattggtttctctatacgataatgacataattgaggaggatgtcatttataaatggtgggataatgtttctactgaccctcgctatgatgaagtcaagaaattaactgtaaagtgggttgagtggttacagaatgctgacgaagaatcttcctcagaagaggaataa

SEQ ID NO: 418 - DNA, 336 bp, Saccharomyces cerevisiae; identical to SEQ ID NO: 324

SEQ ID NO: 419 - DNA, 2460 bp, Saccharomyces cerevisiae
atgagttctttggacgaggatgaagaggacttcgaaatgctggacacggagaacctccagtttatggggaagaagatgtttggcaaacaggccggcgaagacgagagtgatgattttgctatagggggtagcaccccgaccaataaactgaaattttatccatattcgaacaacaaattgacaagaagtacggggaccttgaacctgtcattaagtaatacagctttgtcagaggctaactccaaatttcttgggaaaattgaagaagaggaagaagaggaggaagaaggcaaggatgaggaaagcgtggattctcgtattaaaaggtggtctccgttccatgaaaatgaaagtgttactactcctattacaaaaagatctgcggaaaaaacgaacagtcctatttctctcaaacaatggaaccagcgatggtttccgaaaaatgatgctcgcactgaaaatacatcctcatcctcttcatatagcgtcgctaaacctaaccaatcagcctttacgtcttcgggcctcgtatctaaaatgtctatggacacttcgttataccctgcgaaattgaggataccagaaacaccagtgaaaaaatcacccttagtggagggaagagaccataagcatgtccacctttcgagttcgaaaaatgcatcgtcttctctaagtgtttcccctttaaattttgttgaagacaataatttacaagaagaccttttattttcagattctccgtcttcgaaagctttaccttccatccatgtaccaaccatagactcatccccactgagcgaggcaaaatatcatgcacatgatcgtcacaataaccagacaaacatcctgtctcccactaatagcttggttaccaacagctctccacaaacattgcattctaacaagttcaaaaaaatcaaaagagcaaggaattcggttattttgaaaaatagagagctaacaaacagtttacaacaattcaaagatgatttatacggcacggacgagaatttcccacctccaatcataatatcaagtcatcattcaactagaaagaaccctcaaccttatcaatttcgtggacgctatgacaatgacactgacgaagagatctccactccaacaagacgaaaatctattattggggcaacatctcaaacacatagagaaagcagaccattgtcactctcctctgccatcgtgacaaacacaacaagtgcagagacgcattccatatcttccaccgattcttcgccgttaaattccaaaaggcgtctaatctcttcaaataagttatcagcaaatccagattcccatcttttcgaaaaatttacgaatgtgcattccattggtaaaggccagttttccacggtctaccaggttacgtttgcccaaacaaacaaaaagtatgcaatcaaagccattaaaccaaacaaatataattccttgaaacgcatattactggaaattaaaatactaaacgaggtaacaaaccaaattacaatggatcaagaagggaaggaatacatcatcgattacatcagttcctggaagtttcaaaattcatactatattatgacagaattgtgcgaaaatggtaatttggatggatttttacaagagcaagttatcgcaaagaaaaaaaggttggaagattggagaatttggaaaatcatcgtggaattaagcctggctttacgattcatccatgattcttgtcacattgtgcatctggacttgaaacccgcaaacgtcatgatcacatttgaaggtaacctaaaactaggtgactttggaatggctactcatttaccgttggaggataaaagttttgaaaatgaaggtgacagagaatatattgcaccagaaatcatttctgattgtacgtacgattacaaggcagatattttttccctgggtctgatgattgttgaaattgcagcgaacgttgtgttacctgacaatggcaacgcatggcataagttgagatcgggtgatttatcggatgcaggaagattaagttccacagatattcattctgaatcattattttcagacattacgaaagtagatacaaatgatttatttgattttgaaagagacaatatcagtggtaatagtaacaacgctggcacctccactgttcataacaatagtaatatcaacaaccctaatatgaataatggcaacgataataataatgtcaatactgccgctaccaagaatcgtcttattttgcataaaagttctaaaattcccgcatgggtaccgaaatttcttattgatggtgaatcacttgagagaatagtacgatggatgatagagcccaattatgagagaaggcccacggcaaatcaaatcttacaaactgaggaatgcctgtatgtagaaatgacacgcaatgcaggtgctattatccaggaagacgactttggacctaagccaaaattttttatatga

SEQ ID NO: 420 - DNA, 1668 bp, Saccharomyces cerevisiae
atgtctacagatgaaagtgaagacgtttattctgatctgtattccattatctcccaggtaacatccaatactgccaatgacatcgagcaactcccatatgctttaacgttcaaaacgtcgttaatcttcgttggtgctaccattggtgggcttttattcggctatgatactggtgttatatcaggtgttctgctttctttaaagcccgaagatctatctttggtagttttaacggatgttcagaaggagctgataacttccagtacaagcgtcggatcattttttggctctattctggcatttcctttagcagataggtatggaagaagaattactctcgcaatctgctgttcaatttttatcctagctgcaattggaatggctatagcaagaacattgacgtttttgatttgtgggagattgctggttgggatcgctgttggagtgtctgcccagtgcgtccctctatttctgagtgaaatttcaccttccagaatcaggggttttatgttgacattgaacattattgccatcactggaggtcaattggtttcctatgtgattgcgtcccttatgaaagagattgataattcatggagatatttgttcgcactttctgctattccagctattctgttcctttcaatactggattttatccctgaatcgccacgatggtccatttccaagggagacattctatataccagggattctctaagaatgctatatcctactgcatctacatatcatgtgaatagtaaaattaagcagctgataattgaactcgataagttacgactatacgaagatgcaagtgaacctttactagtacagtcccaatcggttattcgatacatggatagttcaacctcaggaactcttagcccacctaacattaaaagactttcctcgaacacagaaagaactagcaacacaatgtcctcctcatcagcatatctatcggcgttgcgaggcccagctccaaacggtgccctggcatctaacaaaaagaaaagacacagaatggagccacgcacaataagagcgttaatagtaggttgcatgttaatgtttttccagcaaatcactggctttaatgcttttatgtactatgcggcaataatattttccaaatttaatataaaaaaccctctactgcctccaattttgattgcctcaacgaacttcatattcacttttttcgccatgtacaccatggactctttgggaagaagagccattcttttgagaacaattttgattatgactgttgggttacttctttgcagtgtaggtttcggtcatgaccaagtcaatttacttttaatttctgttgtaatttatgttgcagcatatgcttctgcgatgggcagcgttccatggacctgtgtggaatttctccccttgaacaggagatcatttggggcatcatgtatagcctgcacaaattggttgaccaatgcatttgtttcaatgacatatctgagcactattaacaccattggtgatgaaaatacaatgctcatttttgcttttttcacagtttgtgcctggtttttcgtatatttttggtatccagaagtcaaaggtttgtcactggaagaggttggaagggtttttgataatggaattgatgttcattatgtctttcgtacctaccattga

SEQ ID NO: 421 - DNA, 2493 bp, Saccharomyces cerevisiae
atgacatctgcattaagggttttggtatgcggagatcacccaaatctcattctgtacacatccaggtttcaacatgccaaaaatatagaattttatcttgtgaacaactcaaaaaatgccaactacgaggttagttcactattttatgggacggaacggtttcagattcaaaaccatttccaatcgctcctagatttagtagaccttaataatgaaaatggtggcttggtattcgacttgataataatgagtgcgtcttcactgcaagaaatcccgcaggtattgagagatataaaacctatgatgaataagacaacaaagatactatttgaaagtagcgggtttatatatttggagccattcatcaaggcttcagttgatctttcgctgtcaaatattttcagcattttcaccgattatgacataagacggttggacaatggctcatacaaacagttcacgactgcaaatgccaaatccttttctgtttcgatcggtcaaacgacatccgttcacgaaaacagctattcaagtgatattattcctattttgaatacatttcagaaattgttccaaaaactgtttcctagggacgttgtgactctttacgatcattctccctccgctttcttggcaaaagaatgggaactagctttgcctcaaatatgtttcgatccattattaataatattagaagagaagaatccatcaaccttggatgaccacgttttggccaaacctcttatttcaggtttactaggcgagagcttattaataataaaaaaaatgggtatagccatgaacaatccaaattttcaaaatgaacagactatattgaaacattggaagaataagtgcgaagacttacctgatgggccggcacttttatataatttcatccataaggcttcatctttgaatattgacttattgttattacagccgatattattagcagatgactttggcgtgaagacaccatatttagaatgtttgtttacaatgatgactcaatatcaattgttaaataaaggtgattctgaatggtttattagaaaggatgagaacacagcgttaactcgcgttgatgatttacaaaacagtatcgcacttaaagatggaaaaatcatgcagctgcaaaattcggaatcaaccctgaaaaatgagataaaagaacttcaaagtcaagttttgagcttaaaacaagaagtgtcctcaagtaaagcaaataatggacaagagttggaaattttaaagaagaaagtgcaaatgggagacaattcattatttgatcgcccaaatagtaatactaatggtatatctccctctgataacattgttgatgttgatttaaattacgaaaggagtgaccaaggtaataatagtagtggtaatgatagcagaagacaatcttttttcaactccacatctgatacaacattatccagagatgaaacctcgttgaaagagcgtgagttagaagtacgaatgaaggaattagaacttcaagagcgtgagttagagttacagagaaaagccctccagcaacaacaacaatatcaacagagaccgcctaagcaagtatactccggtccttctggtacaccaaccagcggcaataacaataataaaagttacaatccaaatagaaaatcttcctatagtcagcctcaacatgtggctatgatgaccagcagaggtctacatggtcctagcgctgcaagctctagccctgtcatttctgccaacaattttgttgatccagtttcttctgggacgccatatagcagcaatagttctcgatttagtcagcaaattccatcgcagcaatacatgcatactgttaagccaacgagtagaaaaaacagaagtagtgtcatgcctaatataggttacgtcccagggctaaccaataacgagtatggtagaaagtttaacggtaatggtatgaatggtacccaaagccgtctgaattcactttcaaaccaaagtacgtttagatctcaacagggtccaccgataacacagcaaaaatcgtttcaaaataacggtggtagcatgaggacaaatcgcataccatctgcaaattacaatatttcaaatcagcaatcgggttttgttaactctatttcaagtccaaatctaagcaatttggagaatagaaacacagtacaaaacagtagaaatgcggattctgctccgtgcgttaatcaattgaacagtgactctccgccccaattacagtctctatctcaaaacggtacctcaaaagttcctcagatcaatattacgcaaccatcaccaattcagaccaactttgctacgagtgataaccctgctgctgtaataaaactagggacaccttctgaagatacagtttcagctgcggcaacagccaataatataagtacaatgggagatgaaagccgcaaagaggacgttaaggaaaaaaagaagaaaaagttcagtttctttggaaaaaggaaaaagtaa

SEQ ID NO: 422 - DNA, 1731 bp, Saccharomyces cerevisiae
atgatcgccttaccagtagagaaggcccctagaaagtccctatggcaaaggcacagagcctttattagtggaatagttgcccttattatcatcggcaccttcttcctcacttcgggtctccacccagcaccacctcatgaggcaaagcgtccacaccatggaaaaggtcccatgcactcacccaaatgtgagaagattgaaccattaagtccatcattcaaacattccgtcgacacaattcttcatgaccctgcctttagaaacagctccattgagaaactgtccaatgctgttagaatccccactgtagtccaagacaaaaaccccaaccccgcagatgatccggatttctataagcatttttatgaactacacgactattttgagaagactttccctaatattcacaagcatttgaaattggagaaagtcaatgagctgggtcttctatacacatgggaaggttctgatcctgatctaaaaccattattgttaatggcccatcaagatgttgtacctgtaaacaacgaaactttatcatcctggaagttccctccattttctggtcactatgatccagaaacagattttgtttgggggcgtggttctaacgattgtaagaacttgttaattgccgagtttgaagctatcgaacaactgttgatagatggattcaagcccaacagaactattgttatgtcgcttggttttgatgaagaagcaagcggcaccctcggtgctgccagcttagcctcatttcttcacgaaagatatggtgatgatggtatttacagtatcattgacgagggtgaaggtatcatggaagtcgacaaggatgtctttgttgccactccaatcaacgctgaaaaaggctatgtcgacttcgaagtcagtattctaggccatggtggtcattcctctgtcccacctgatcataccacaatcggtatcgcttcagaactgattactgaatttgaagccaacccatttgactacgaatttgagtttgacaatccaatctatggattgttgacatgtgctgctgaacattctaaatctttaagtaaggatgtgaagaagacaattttgggcgcaccattctgtcctagaaggaaggacaagcttgttgagtacatttccaaccaatcacatttgcgcagcttaataagaacaacacaagctgttgatatcatcaatggtggtgttaaagctaatgctctgcccgaaactaccagattcttgatcaatcacagaattaatttacattcttctgtggctgaagtctttgaaagaaacatagaatatgcgaaaaagattgctgagaagtatggctatggtttatctaagaacggtgacgattacattatccctgaaaccgagttaggtcacattgacattactctcttgagagaattggaaccagcaccactttcgccaagttcaggccctgtttgggacattttggcaggtactattcaagatgtttttgaaaacggtgttctacaaaacaacgaagagttctatgtgactactggtttattctctggtaacaccgatactaaatactactggaatttgtccaagaacatttataggtttgttggctctatcattgatattgatttactgaagacattgcattcggttaatgaacacgtggatgtcccaggtcatttatctgccattgcctttgtttacgagtatatcgttaatgttaacgaatacgcttaa

SEQ ID NO: 423 - DNA, 2199 bp, Saccharomyces cerevisiae
atgaccacacaaataaggtctccccaaggcttgccgtatccgattcagatcgataaactcattccaagcgtaggttcgtaccttcatgagggtgataggttgcttgtctataagttctggtatttggtggaaagggcctcagacactggtgacgatgataacgagcacgatgtttcccccggcggcagcgccggaagtaatggtgtctctccgccaaccaaacaactgcgtgaatccatagaattcttcgaaagtccctacgagggggacttgattagttggaatgtagacgtaggagatgaagtagccactgctaaccaagtgatttgcgaaataaaaaggccatgtaaccatgacatcgtgtatggcgggctatgtactcaatgcgggaaagaagtttctgcagatgccttcgatggtgtaccactagacgttgtcggggacgtggatttacagattagcgagacagaagccattagaacaggcaaggcattgaaggagcatttgcgacgggataagaaacttatcttagtggtggatttagatcaaaccatcatccattgtggcgtggaccctacgattgcagagtggaagaacgaccccaataatccgaattttgaaacattaagagacgtcaagagctttacgttggatgaggagttagtactcccacttatgtacatgaatgacgatggttctatgctgagaccgcctcccgtaagaaaatgttggtactacgtgaaggtaaggcccggtttaaaggaatttttcgctaaagtggcgcctctttttgaaatgcatatctacacaatggctacaagggcttatgccttgcaaattgccaaaatcgtggaccctacgggcgaattgtttggcgatagaattctgtcgcgtgatgaaaatgggtctctaacaactaaatcattagctaaacttttccccactgaccagtcaatggttgtagttattgacgacagaggtgatgtttggaattggtgtccaaacttgatcaaagttgttccttataacttcttcgttggtgtaggtgacattaattctaatttcttgcccaaacaatctacaggaatgctacaactagggaggaagacaagacagaagagccaagaatctcaggaactgctgacggatattatggataacgaaaaaaaactacaagaaaagatagataaagaagttaaacgccaagaagaaaaattgaaccatcaactggcgactgctgaggagcctcctgcgaacgaatccaaagaagagttgaccaagaaactagaatattcagcatctttagaagtccaacaacaaaatcgacccttggccaaactacaaaaacacctgcatgatcaaaaactactagttgatgacgatgatgaactatactacttaatgggtacgctatcaaacattcacaaaacttattatgatatgctctcacaacaaaatgagccagaaccaaatctgatggaaatcataccaagtttgaagcaaaaagtcttccaaaattgctattttgttttttcaggattaatacccctcgggaccgatattcaaaggtcggacatagtgatatggacgagtacatttggtgccacttccactccagatatagattacctgacgacacatttaatcaccaagaaccctagcacttataaagcgcgtctagcgaaaaagttcaacccacagattaaaattgttcacccagattggatatttgagtgtttggtaaattggaaaaaggtggatgaaaaaccctacacgttaatcgtggacagccccatctccgacgaggaattacaaaactttcaaacacaattacaaaaaagacaagaatatctggaggagacccaggaacaacagcatatgttgacatcacaagaaaatctaaatttattcgctgctggtacttcatggttaaacaatgacgacgatgaagatattccggacacagctagcgacgacgacgaagatgacgaccacgacgacgaaagtgatgacgaaaacaactcggaaggcattgacagaaagaggagcatcgaggacaatcatgatgatacatcacaaaagaagaccaaggcggaaccttctcaagatggtcctgtacaacataaaggagaaggggatgacaacgaagacagcgattcgcagttggaggaagagttgatggatatgctggatgattag

SEQ ID NO: 424 - DNA, 936 bp, Saccharomyces cerevisiae
atggtatctagaggccccgacgaatggcttgaaacaataaagaaatgccaggcgctaactgaaaacgagatgaaacaactgtgtgaaatggtgaaagaacttttgatggaggaaagtaacatccagccggtacagacccccgttactgtatgtggagacatacacggccaatttcatgacttgttagagctattccgtacggcgggtggctttcctgacgatataaactacatttttctcggtgattacgtggatcgtggctactatagtctggaaacttttacgcttttaatgtgtctgaaagtcaagtacccggcaaagataactttggtcagaggaaaccatgagtccagacaaattactcaagtttacgggttctacgaggaatgcctgaataagtacggatctaccaccgtatggaagtattgctgtcaagtttttgatttcctgacgctggccgctataattgacggtaagatcttatgtgtccatggagggttatctcccgagattagaatgctcgatcaaatcagagtcttgtcaagagctcaagaagtgccacacgagggtgggttctcggacctgctttggtcagaccctgacaatgtagaggcttggcaagtttcccctcgtggtgcaggatggctctttggcagtaaagttgctagagagtttaaccacgttaatggactgaaccttattgcccgggctcaccaactggttatggaggggttcaagtaccattttcctgaaaaggacgttgtaaccgtgtggtccgcgccaaattactgttatagatgtggtaatgtcgcgagtgtaatgaaggtcgatgaggatctggaacctactttcaaaattttctcggctgttcccgatgactacataagagaatccacggcaaaccataataatcaaagagccggctatttcttataa

SEQ ID NO: 425 - DNA, 3405 bp, Saccharomyces cerevisiae
atgtcaaattccaattcaaaaaaacctgttgcgaattacgcataccgtcaacagcaagattataatgggatgaacgccatggtgggaaatccaatgatgtatcatcctgttgatttcgtaaacggtgccggccaatatggtccttctcaacacccagcatattacaccaactcaccattacctaatattccaccaacaccttttgatactgcatacggtgccagtctttttccatctcacctattgatgggatctccatttgtttcctcgcctaacatgcaaagtggctataattctgcaagatcatctaatctcaaaagaaaggcttattcgaggcccgtttctaatcataacggttacaacggaaacagtaacagtaaccaaaacaatactaataacggaatggtaacaccctcgaactattatagaatggggagaaattctttctcgaggaacaacaacagtacgaggaatgttactcacaacaacaataaggggtgcgacacccggaacaacagtggaagaagaacattcgcaaggaataacattttcgacgacatacttccagaaatgcttttacaaagacccttttgtattaattacaaggttctaccgactggtgatgatgcttatagaactaggtcgctgcttattgaaaatgtggatcattctattgatttacactctatagtcaaaaattttgtcaaatccaatactctggaaagtgcctacttaattgaaggagggaagagcgatgattcaaaagatgtagagactaaaaatctatccattctaataagctttctaaccaaaggcgactgtttgaacttttacaataacattttacaaaggttatctgaattcaaaacatttttgaaatctgaagcactaaatctgaaatttgtttgtctaaactatgatcccaaatgcctccctacctttattgagagtgaagcgttaacagaaaacgctgaagaagccgacattaccaatggttcaacaatgatcagtgcttcgctgcatcataatatagcgaacaaagatgctacaaggtcgattataattgaattcaaaagccccgtggagaaaagcgatttattcaaaaagaaattacaatttttggacaggtcaaaaaacaaaagatacattttggaatctatcgatttagtgaacacagatgtaccttccaatcaatttcctgaaaattacgccgttttaacctttttgaatatctctatggctattgaagttctcgattatttgaaaaaatactccaaaaacttaggcatttctaaatgtttttacgtatccctagccccgttggtagttagctcagccagatcttcggttgctaatatttacgagggtaaaacgagcacacatcgtttatcggtgccttctgttactgctgggaacaataacgatagcaacaacaacggaaacaataataaaagtaatatgagtggtatcaccacactcaataataatagtagtattggtgtttccgtatacggtcactctaatatgagtttaaccagtctgtcatcatctgtatctttaaatgaagagattgatatgcttgcgacgaaacttcaaggggtagaacttgatgggacttatttagaaatcaactatcgcgactatcaaacaccaactattgaagaacactctactcacttgagcaatgtcaaaatttcaaagacaacagaaaactctaggcaattttctcaagatatcccatcacctttgccattaaatgaacatatgtttatgaatgattctaatcagtccaatggagcgataatacctcaacagttaatagccacaccttctccggtatcccccaatttgcaaatgaatcaaagggtgttgccgaatccaataactcaaagtttggagcaaaatttcaacgtttcggccaaagtggcatcatccatgggttcagacataggcaatagaacaatttatataggaaacattaatccaagatcaaaggcggaggatatctgtaatgtcgtgcgtggaggaatccttcagagcattaagtacataccggagaagaagatatgctttgttactttcatcgaagctccatccgctgtacagttctatgcaaattcatttattgatccaatagtgttacatgggaatatgttgagagttggatgggggcattattctggtccattaccgaaattaatctcgttggctgttacgatcggggcaagtaggaatgtctacgtaagcctaccagagtttgcatttaaggaaaagtttattcacgaccctcagtacaaaaaattgcatgaaacactatctttaccagatgcggaacaactaagagaggactttagtacctatggtgatattgagcagattaactatttgagtgatagccattgctgttggataaatttcatgaatatatcttctgcgattagtcttgttgaagaaatgaataaggaatccacagtacaaaatgaatccggtgaagtgacgcttaaaagggcgactgaggaaaaattcggtggccgttataagggccttctgataaactacggcaaagatcgttgtggcaatataaacaaaaatttgatagcaggtaaaaattcaagattctataagaaagttaaaagaccgagctataatatacgtttgagtaagttggaagaaaagaggaggcagaatgaaatcgatgaaaaggaaaaggcttttgataaacccttgaacttggaatccctaggaattagtctggacgcacataaggacaacggcggtggtgaaacaggaactgcaaataatactgggcatgaaaatgaaagtgaactagaggctgaaaatgaaaacggtaatgagactggaagtttcggtggactgggtctcgctgtggcgagctctgacgtcaaacgtgcgacatcggatgaaactgattatgaagatatatttaacaagtcatcgggatcttccgactcgtcatcagacgtcgaggtcattatgcactccccgagcgatcctgaatacgctttaaaatcacaaactctaagaagctcgagtcagaccgtcattaatagtaagagaccagtaaagatagaagacgaggaagaagccgtaggaatgtcacagctcaattataggtcgtcattaagacaagctcctccaagagctccctcaactttgtcatataatcactcgaagaacaacgaaacgccaatgcaagatattttcacaaatggcgaaacagcaaataacagaaagaagaagagaggatcttttgcaaggcatagaacgataccaggatctgacgtcatggcccaataccttgcacaagtgcaacattcgacatttatgtatgcagccaatattttgggcgcctctgcggaagacaacacgcatcctgacgagtag

SEQ ID NO: 426 - DNA, 345 bp, Saccharomyces cerevisiae
atgtcccaaaaaaacggaattgccaccctactacaagctgaaaaggaagcccacgaaatagtatcaaaggctagaaagtacagacaagataagttgaagcaagccaagactgatgcagccaaggaaatcgactcatacaaaattcaaaaagacaaggaattgaaggagtttgaacaaaagaatgccggtggtgttggtgaattggaaaagaaagcagaggctggtgtgcaaggtgaattagctgagattaagaaaattgcagagaagaaaaaggatgacgttgtcaaaattttgatcgagactgtcatcaagccttctgctgaagtccatatcaatgccttgtaa

SEQ ID NO: 427 - DNA, 2841 bp, Saccharomyces cerevisiae
atgggcaaattcggcacgacaaataaatcaacggagaatcttctgcgtgataaattcgtacccgagacatctccaactaatattcccactgatgtactcatcaagcaagggcaaataacggattccaccgaatcactaattcatggaggcgcagaaaggtatattgttaacgctttaaagcctatagaattaaataaaactgaaggctttttcgaagacccgccgttccatcttccttctccaccggttgattcgacaaatctggagtatgaagacgttaccgatcttcctaagaatggtttacgatatgatttgaatgatatatccgttgaggtaatcgaagatttataccgccagattgaagcttttttggttcatttcaaactatccagaagttttttacaaattttcaaaaactatgtcaatattcttattcaagaaggcatcaatcctttacgcgatgagtacttcacaatattggaagatgaactgaaaggttttttcactttcaattctgttatagaagagattttagaaatatttttaatccaccctcgcaacaaattcattgcattgtcccttgcagaatatacctacgctaagaacaaaatcagaagacattttaatcactggaagactgtatgtgaattgaatgaagaggcaaacaggtttgcaaatcaagcaaagctgagggtacaggaagccgtcttctatatttggagtgataaaacattaaaatactcacagatggccaacgatgaagctgaaagttttaggaatacttggctactatttcgctcgttccaacaatggataactttaacacaaactcttaaggagcagtcaaggttagcagatcaggcctttttgaataagatgtttaggaaaattttaaaggcacaagagcattggaaacacttagaaactgttaacactgacaacattaagaagatatttttacgaacaacatttcatatatggaagctaagacataaagaaataaactaccacgggttggaaagaaggattttcgaaagaataaaacagaaagttataaactatgaatacaataagagcattgcagaaaaagtgaggtcgttttctctacaaagaaaatatctgaataaatgggaaaagaaaaacattgaaaacgaagataaacttggggcactttatgaactggagaataaattcatcaaacaaaagttttttcgcaaattaaaccggtcatttcaacatagtcaacaagaggcaattgcaaagagtaaactaaatcagacacttttgaggtgcgtttttgagaagatgtggctgaaaagattcgaagaccatctgcatttgtattcaattgtaagtctaaaagaggctaacctcgtgaagcgtatttttcattcatggaaaaaacttctatatattgacctcaaagcaagcgattattcgaggactaatttgctcaagtcatcattgcgaagttggaaacttgaagtaaagttaaaaatatttgagcagaaatgtaaaaagagtattcaagcaagcgcgtatcgtacatggaggaaaagaatacagtatgggaaaatatcgagcgaacatgttaaaacggcattttgtgcaaaatatcttggtgtgtggaaaaggaggatgctacaaatgaattctatgaatgacgaagcatccaaattttacgaagagggtctcgtaaatgagtgtctagctatatggaaagaacgcctgattaaaactaaggaattggaggatagatacaatttcttatgtaagacacatgcaattttgactgtaaaacggacgctaatgcatattgataatgttcatttgctatatacgaaactggcgccctctatggatagagtaaagctttctaaggcctttttaaagtggcggaaagccacaaggttcaaagtcaggcataagttaaacgatattttacacgtttatgaaaagagtaaagagcgcgaacttcaaagccaactgttcaacgcttggcgaaatagattttgcttctacacagaagaatgtaacattcaggctatttcaaagagaaactaccagcttgaaaaaatggtgctgaagaaatttagagaaagacttttagagatagtaaaatcagaagaattagcagacgaagttcgcgaagaatttgtgttagtcaagacgttttatatttggaaaactcatctagacgaaatattttatatgagtacattattggaacaatcggaagctaataaacaattcataattacatccaaattcttgaaaatgtggagtcttcgattcctaaaaattaagcgtaatgatgagacagtcgaggtgtttcgtcatcggtgggacagggccactgtaaggggattgttattattatggaaaaatcgttcagacagttctccaaagagaaggaaggacttcaatcttaaacatgaactaaaaactcccataagatcagactctcaaaacgcctcaaccataccaggctcagaaagaataaagcagcacagaatggaagcgatgaagtcgcattatagcagggcaagaagagccataccaagtccggtgaaatcttccagtgttcttgattctacagctaaaaaacagatcaaccttgaaagtacgacaggcttaaacggatctccgacgcgaggaaaacctctaaggtattctcctaggcgtaccactagaaacatgccatccaaagttgaccatattgattttggcagaatacccgctgtaccttttagcctaagcgccaattctcctaaaatcgatcaagatatggattatataagagagcatgataaatccccgttaagtcgtaaacgtcaatag

SEQ ID NO: 428 - DNA, 1254 bp, Saccharomyces cerevisiae
atgtcagaccctatcagaacgaaacccaagtcgtcgatgcaaatcgacaacgcccctacgcctcacaataccccagcatcggttctgaatccgagctatttgaaaaacggcaacccagttagggcccaggcacaggagcaggatgacaagatcggcaccatcaacgaggaggacatcttggctaaccaacccctgttgttacagtccatccaggacagacttggctcgctggtgggccaggacagcgggtatgtggggggtcttcccaagaacgttaaggaaaagctgctgagcttgaagactttacaaagcgagctattcgaagttgaaaaggaatttcaggtggagatgtttgagctagagaacaagtttctgcagaagtacaagcccatttgggagcagcggtccaggatcatttcaggacaagagcaacccaagccggaacagatcgcaaagggccaagagattgtggagtcactcaatgagacggagttgttggtggacgaagaagagaaggcccaaaatgattccgaggaggaacaggtgaagggaattccctcattctggctaaccgcattagagaacttgcccatcgtttgcgacacgatcactgaccgcgatgcggaagttctggagtacctgcaagatattggtctggaatacttgacggatggtagacccggtttcaagctgttgttcagatttgattcttccgccaacccattcttcaccaacgacattctgtgcaagacctacttctaccagaaggagctcggttactccggggactttatctacgaccacgcagaaggctgcgagatcagttggaaggacaacgcccacaacgtcactgtggacctagaaatgcgcaagcagagaaacaagaccaccaagcaggtgaggaccatcgagaagatcactcccatagaatcctttttcaacttcttcgaccctcccaagatccaaaacgaagaccaagacgaggagttggaggaagacctcgaggaacgtctagctttagactactccatcggggaacaacttaaggacaagctaattcctagagccgtggactggtttaccggcgcagccttggaattcgagttcgaggaggacgaagaagaagcggacgaggacgaagacgaagaagaagatgatgatcacggcttggaggatgacgacggggaatctgccgaagagcaagacgattttgctggcaggccggaacaggctcctgaatgcaagcagtcataa

SEQ ID NO: 429 - DNA, 1362 bp, Saccharomyces cerevisiae
atgaagatgagcctcgaagtttatctaaactaccaccaaagaagaccgactagatttacaatcatgtatccaggtagtggacgttacacctacaacaacgctggtggtaataatggctaccaacggcccatggctcctccacctaaccagcagtatggacagcaatatggtcagcaatatgaacagcagtatggacagcaatatgggcaacaaaatgatcagcaattcagtcagcaatatgctccaccaccaggtcctccccctatggcttataacaggcctgtgtatcccccccctcaattccagcaggaacaggcaaaggcacaattaagcaacggctacaacaatcctaatgtaaacgcatccaatatgtacggtccaccccagaatatgtcattacctccacctcaaacacaaactattcaaggtacagaccaaccttatcagtattctcaatgtactgggcgtagaaaggctttgattatcggtataaactacataggttcaaaaaatcaactgcgtggttgtatcaatgatgctcataacatcttcaactttttgactaatgggtacggttacagttcagatgacattgtcatattaactgatgatcagaacgatttggtcagggttcccactagggctaatatgattagggccatgcaatggttggtcaaggatgcgcaacccaatgattctttgttccttcattattctggacatggtggccaaactgaagatttggatggggacgaagaagatgggatggatgatgttatatatccggtcgatttcgaaactcaagggccaattatcgacgatgaaatgcacgatataatggtgaagcccttacaacaaggtgttagactaacagcattgtttgactcttgtcattcgggtacagtgttggatcttccatatacctattctactaagggtattattaaggagcccaatatttggaaggatgttggccaagatggcctgcaagcagctatttcatatgccacaggaaacagggctgctttgattggttctttaggttctatattcaagaccgttaagggaggtatgggcaataatgtggatagagaacgcgtgagacagatcaaattctcagcagcagatgttgttatgttatcaggttcgaaggataatcaaacttctgcagatgctgtcgaagatgggcaaaatacaggtgcaatgtcccacgccttcatcaaggttatgactttacaaccacagcaatcatatttatctcttttacagaacatgaggaaagaattggctggtaagtattctcaaaaaccacaattatcatcgtcacaccctattgacgtaaatctgcaatttattatgtag

SEQ ID NO: 430 - DNA, 1164 bp, Saccharomyces cerevisiae
atgactgaattcgaattgcctccaaaatatatcaccgctgctaacgacttgcggtcagacacattcaccactccaactgcagagatgatggaggccgctttagaggcctctatcggtgacgctgtctacggtgaagatgttgacaccgttaggctcgaacagaccgttgcccgcatggctggcaaagaagcaggtttgttctgtgtctctgggactttgtccaaccagattgccatcagaactcacttgatgcaacctccatactctattctatgtgattacagggctcacgtttacactcacgaagccgctggactggcgatcttgtctcaagcgatggtggttcctgtggttccttccaacggtgactacttgaccttggaagacatcaagtcacactacgtcccagacgacggtgatattcacggtgcccccaccagattgatttctctggaaaacactttacacggtattgtttatccattggaagaactggtccgcatcaaagcttggtgtatggaaaatggtctcaaactacattgtgacggtgccagaatctggaatgccgctgcacaatctggcgtgccattaaagcaatatggggaaatcttcgactccatctccatctgtctatccaagtctatgggtgctcctattgggtccgtcttggttgggaaccttaagtttgtcaagaaggccacccatttcagaaaacaacaaggtggtggtattagacaatctggtatgatggctagaatggctcttgtaaacatcaacaacgattggaagtcccaattgctgtactcgcactctttggctcatgaattagccgaatattgtgaggcaaagggcatcccgctagagtctccagcagacaccaactttgtctttattaacctgaaggccgctagaatggacccagatgtccttgttaagaagggtttgaagtacaacgttaagctaatgggtggtagagtctcgttccactatcaagtcaccagagatactttggaaaaagtcaaattggccatctccgaggccttcgactatgctaaagaacatcctttcgactgtaacggacctacccagatttaccgtagtgaatccaccgaggtcgacgttgatggcaacgctatccgcgaaataaaaacctacaaatactga

SEQ ID NO: 431 - DNA, 2469 bp, Saccharomyces cerevisiae
atgctggaaggtacggtagattatgacccgctggaagatattaccaatatacttttttcaaaagaatccctgaacaacatagatgaactgatcagtattaccagaagctacaaaaagcaattgcaagaggatattctcaaagaagagaatgaattgaaggaacaccctaaaaattccgctgaaatagaggcttctctgaggaaagttttccaagatttcaaagaaactcaagatgtctcagcctccaccgagttgacgatatcgaatctgacagaaggtatctcgtacctggacattgccaagaaaaacctcacccactctttgactcttttccaaaatttaaagatattgacagacagttacatacaatgcaatgaattactctcacagggctcattcaaaaaaatggtgtccccttataagataatgtgttcgcttgctgaaaacacattcatctcttacaaatcattggacgagataaactatttgttgagctccatttcaagactgaaaggagacactttgtccaaaattaaacaaaactacaatgcgctcttttccggcggcaatatctcagagcatgatacagcactcactatggaattgcgcgaaggtgcctgcgagctactcgactgcgatacaagtacgagagcccagatgatagattggtgtttggacaaacttctcttcgaaatgaaagagatatttagggtcgacgatgaagccggatccctagaaaatttatcgagaagatacatttacttcaaaaaaattcttaataacttcaattcaaagttcgcagactatttcttaaaagactgggaaatggcagtcagattgaccaccactttttatcacattacacacaaggaccttcagacacttctgaaaagggaattcaaagacaagaacccttccattgatctattcatgacagcattacaatcgacgctagatttcgaaaaatacatcgacgtacgattttcaaaaaaaattaaggaaccaaaactaagttcctgcttcgaaccttatttgactttatgggtgtctcaccaaaaccaaatgatggaaaagaaatttctttcttatatgagtgagccgaagtacccatctaatgaaacagaatctctcgtgttaccctcgagtgcagaccttttcaggacatatcgttccgtactgactcagaccttagagctcattgataataatgccaatgatagcatattgacttcattggcaaattttttcagtagatggcttcaaacttactcacaaaaaattcttcttcctttactgctgcccgacaatattgaagtccaggataagctagaagctgccaagtataccgttttattgatcaatactgcagattattgtgccacgactatagatcaattggaggataaattatctgaattcagcggtaatcgtgaaaagctggcaaacagttttacgaaaacgaaaaatatatacgacgatttactagcaaaaggaacttcttttctattaaaccgtgtcatacccttagatctaaattttgtatggagagagtttatcaacaatgattggtcaaatgctgcgatagaagattatagcaggtacatggtaaccctcaaatccgtacttaaaatgcccgcattaacagatgcctctattaaacaacagcaagagcaaccttcgactttggcatttattttgtcgcaattcaatagagatgtttataagtggaatttcttggataaggtgattgatatcatcactacaaattttgtaagcaataccatccgccttctgcagcccgttccacccttttccctggcgggcagcaaaaggaaatttgaaaccagaactgttgtcaacattggcgagcagcttctccttgatttagaattgctgaaggagatttttcacactttaccagaaagtgtaagtaacgattctgacttgcgagaaaatacctcttataagagggtgaaaagacatgcagacaataatatagaccagctgctgaagtttattaaacttctaatggctcctctggattccgctgatgactattacgagacctactccaaattgaccaataataaccctgattcagcggtatggtcttttgtcctcgctttaaagggcattccatgggacctggcattatggaaaaagctatggagtgcctacaacttagaaacagacgacactgacgagggcagcaggccagacagtaatcgcgatcttttcatattcaagtgggacaaggtacttttgggtcaatttgaaaacaacttggcaaggatgcaagatccgaattggtcaaaatttgtgaggcaagatctgaaaatatcaccacctgttatgaagaggatagtatccacccctcaaatacaacaacaaaaagaagaacaaaaaaagcaaagtttgagtgtcaaagacttcgtttctcactcaaggttctttaacagaggcacttga

SEQ ID NO: 432 - DNA, 2403 bp, Saccharomyces cerevisiae
atggcttctgtacctaaacgccatacatacggtggcaacgttgtcactgatagggaccgtcattctcttcaaagaaacaatgagattttgcatcctatacataaaaatcagcgaaaacatgctaccttcggaccatacataatcggttccactttgggtgagggagaatttggtaaagttaagctgggttggaccaaggcttcctcctcgaacgaggttcctaagcaagtggcaatcaaattaattagaagagatacaatcaagaaagatgccgataaagaaattaaaatataccgcgaaattaacgcactgaagcatttaactcatcctaacattatctatttagaagaggtcctgcagaattcgaaatacattggaatagtgctagagtttgtatctgggggagaattctataagtatattcaacgtaagaggagattaaaggaatcttctgcatgcagattgtttgcccaattaattagtggggtcaattatatgcactacaaaggacttgttcatagggacttaaaactggaaaatttattattagataagcacgaaaatttagtcatcacggattttggttttgtgaatgaattttttgaagataacgaattaatgaaaacttcttgtggttcgccctgttatgcagcaccagaactagttgttagtaccaaggcatatgaagcaagaaaggcagatgtttggtcgtgtggtgttattctttatgcaatgctcgctggatatttgccgtgggatgacgatcatgaaaatccaacgggtgacgatattgctagactgtacaaatacatcacgcaaacacctcttaaatttcccgaatatataacccctattccaagagatttgctgaggcgaatactggtacccaatccaagaagaagaataaacttacaaacaataaaaaggcatgtgtggttgaagcctcatgaagcgtttttgagcattcagccgaactattgggatgaacacttacagaaggaacgtccgaaaccgccaaacaaaggtgacgttggtcgccactcaacttattcttcatcagcatcttcgtactcaaaaagtagggatagaaactctttaattatagagtcgactctagagcaacatcgaatgtctccacagcttgcgaccagcagaccagcatcaccaacattctctactggttccaaagtggtgttaaacgatacgaaaaatgacatgaaagaatctaatataaatggcgagcgtactagtgcatcatgcaggtacacacgtgattcgaagggcaacggccagacccaaatagaacaagtatcagctagacactcatccagaggcaataagcacacatcggtcgcgggactcgtaacaatccctggctcccccacaactgcaagaacaaggaatgcaccatcatcaaagcttactgagcatgtaaaagattctagtcagacaagctttactcaggaggaattccaccgtattggtaattatcacgtgcctcgcagtagacctaggccaacttcatattatcctggactcagtcgtaacaccgcggataatagtttagcggatattccagtaaataagttgggttcgaatggtaggttgacagatgccaaagacccggtaccgttgaacgcaatacacgataccaacaaagctacaatctccaacaattccattatgctattatcagaaggtccggctgcaaagacttccccagtagattaccattatgctattggcgacttaaaccatggtgacaaacccataactgaggttatcgacaaaattaataaggaccttactcataaagcagctgaaaatggttttcctcgagagagcatcgacccagagagtacctcaacgatattagttacgaaagaacccactaactccaccgatgaagatcatgtagaatctcagctggagaatgttggccactcttctaataaatcagacgcttcttctgataaagatagtaaaaagatctacgaaaaaaaaaggttcagcttcatgtcgttgtactcatccttaaatggttcaagatccactgttgaatctcgtacctcaaaagggaatgcacctcctgtttcatctagaaatccatcaggacaatcgaatagaagtaacattaaaataactcagcagcaaccacgtaacctttccgacagagttccaaatcccgataagaaaattaatgataatagaataagagacaacgcacctagctatgctgaaagcgagaatccgggaaggtctgtacgggcttctgttatggtgtcaacactacgagaagaaaatcgatcggaattgtcgaatgaagggaataatgtcgaggcacagacttcaacagcaagaaaggttctgaattttttcaaaagaaggagcatgagggtttga

SEQ ID NO: 433 - DNA, 2241 bp, Saccharomyces cerevisiae
atgattacgcagaattctataccagaggtaaaagaagattttattggttatgctttacatgagagaagaattcggttaccgcagtttcaagacttagggccggcagacttggtcacactaacaaagtatttgcccacttcaagtaacacaaatgccataaacagtacgagtagaaatggtgcggccattattcagtcccctgcagccgttgtagccgatgactctgccgcttccatggcaaccaatggcgatgctagtgacaccgccgttaccacaaattatacaaatgcatctatatacagtagcagcagaaatgccaatgatggagccccgatggtcgctgagctccatccacttgataaactgaaggacgaagtagggacatttttttactcaatgggtgtcgatacatccggtccaacttcaatcgcaatttttttgaaggagatttcagaggtcatcagcgagaaaccccaagtttggtttggcaggaagaaaaccttcaatgttgctcgaatttcattttccacttggaatgcgttcaggagatgcgacataaatgtcgtcgttcatattccaggatcgattcagaactttatagtggattgcaacggtgaaagtcaaaatatagagatgtgtgcggattatgacttaatttgggctgaaacgttcgtaagtggcgtagtacggtcaatcatgttaatgaaggaaaacgctgaagagggagaattacaaaatttagtggaaaccttgattttgaacccgtttactgcaggacaaatcgacgatgtaccagaaatgttcattgatctgttccctatagtttaccataagggcccattattgggagctccgtattatattaccaatgtgacgaacactaataactatttggtagaaacactcgttgagatagttaagctgactcgtaatgttagcagggcggaaataatgttgaagaatctggctaccgacaaccctgaggcgatcataatactaatcaagatctttttggtgtgtgatcaagaattagacgcaataaagctcacatacgatatgctttcgcaggataaaataataaacaacactaataaccgcatggattataaatctgaattactgtgcttacaagcgcaatttttgatagacaaaaggcaggattacagcttggcgcaaaacatagcgcaagaggcagtcaattgttctcccagtgaatttagaccttggtatcttttatccaaggtgtatgtaaagctaaatgatattgaaaatgccttactgatactgaattcatgccctatgtctccattaaaggaaaaatacgtactgaaaagagtagctccgttgccttcgaataatagtcttcatttgccattgccaattgacgttgtactggatgaagtgacgtcgttgaatccacaagacgttcagaatgaacaccgctctgcggatccaatgctggtcaatttagctgcgtcgaacttgaaatctactttccaattggcataccgattattgacagaaattgtgcagatcaccggctgggaaaatctgttaaagtacagatcaaacattttcgttatggaagaagagtaccaaaaatcatcatcttcgttaccaaaggacgttaacaaacaagaagaacagcctctgagggctaaacggctgtgtgaacgatggttagacaacctcttcatgcttttatatgaagacctgaagatgtatacattatggcaaaccgaacaactgtacatggatgcacagaataacaaccacaataagttgactttcgaatgggagttatttggcctttgtgcacgtcgactgggccatttccctgaggccgccaaggccttccagaacggtttatcgcagagattttcatcaaggtgcgcgaggaaactgctggaatattgtataaacgaacgccaacgggtcaaaaattttataaactcacctaattcgcatgacatggtccctgaaatagtaagctcacgcataagagagctagacaatagcattatcgacctttgcgtgaagatatgctgctggaaccaccgttggtatacggaattttccataagtttacttgattgtttaagtgtggttattcaagatatgagtctgaccaaagtttcgaatgaaatctcgtcaagatatccagaaactgttctcaacttggtgcaggagaatttgctcaatttcttcactacttgcaccattggatgctacgatgcataa

SEQ ID NO: 434 - DNA, 1812 bp, Saccharomyces cerevisiae
atggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggagtcttcagaaaagcaccataaggaaatatggatacaatttggcaccctacatgttcttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttagctacagcgcaacgtatacgtcgacgatacaacaagaacggttcatcggagcctcgactaaagacgcttgacggactcacttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccggaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcatctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgttgctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagcttgggtgctgcagaaaaggtgtctcgcacaaaggagtttgtcactga

SEQ ID NO: 435 - DNA, 2124 bp, Saccharomyces cerevisiae
atgtcagaacaactcagacaaacatttgctaacgctaaaaaagaaaacaggaacgccttggtcacatttatgaccgcaggttacccaacagtcaaagacactgtccctattctcaagggtttccaggatggtggtgtagatatcatcgaattgggtatgcccttctctgatccaattgcagatggtcctacaattcaattatctaatactgtggctttgcaaaacggtgttaccttgcctcaaactctagaaatggtctcccaagctagaaatgaaggtgttaccgtacccataatcctaatgggttactataaccctattctaaactacggtgaagaaagatttattcaggacgctgccaaggctggtgctaatggttttatcatcgtcgatttgccaccagaggaggcgttgaaggtcagaaactacatcaatgataatggtttgagcctgatcccactagtggctccttctaccaccgacgaaagattggaattactatcgcatattgccgattcgtttgtctacgttgtgtctagaatgggtactactggtgttcaaagttctgtggccagtgatttggatgaactcatctctagagtcagaaagtacaccaaggatactcctttggccgttgggtttggtgtctctaccagagaacatttccaatcagttggtagtgttgctgacggtgtagtgattggttccaaaatcgtcacattatgtggagatgctccagagggcaaaaggtacgacgttgctaaggaatatgtacagggaattctaaatggtgctaagcataaggttctgtccaaggacgaattctttgcctttcaaaaagagtccttgaagtccgcaaacgttaagaaggaaatactggacgaatttgatgaaaatcacaagcacccaattagatttggggactttggtggtcagtatgtcccagaagctcttcatgcatgtctaagagagttggaaaagggttttgatgaagctgtcgccgatcccacattctgggaagacttcaaatccttgtattcttatattggccgtccttcttcactacacaaagctgagagattaactgagcattgtcaaggtgctcaaatctggttgaagagagaagatcttaaccacacgggatctcacaagatcaacaatgctttagcacaagttcttctagctaaaagattaggcaagaagaacgttattgctgaaaccggtgctggtcaacacggtgttgccactgccactgcatgtgctaaatttggcttaacctgtactgtgttcatgggtgcagaagatgttcgtcgccaagctttaaacgtcttcagaatgagaattctcggtgctaaagtaattgctgttactaatggtacaaagactctaagagacgctacttcagaggcattcagattttgggttactaacttgaaaactacttactacgtcgtcggttctgccattggtcctcacccatatccaactttggttagaactttccaaagtgtcattggtaaagaaaccaaggaacagtttgctgccatgaacaatggtaaattacctgacgcagttgttgcatgtgttgggggtggttccaactctacaggtatgttttcaccattcgagcatgatacttccgttaagttattgggtgtggaagccggtggtgatggtgtagatacaaagttccactctgctactctaactgccggtagacctggtgtcttccatggtgtcaagacttatgtcttgcaagatagtgatggtcaagtccatgatactcattctgtttctgctgggttagactacccaggtgtcggtccagaattggcatattggaaatctactggccgtgctcaattcattgcagctactgacgctcaggctctgcttggctttaaattattatctcaattagaaggtattattcccgctttggaatcttctcatgctgtttatggcgcttgcgaattggctaagacgatgaagcctgatcaacatttggttatcaatatttctggtagaggtgataaagatgtccaaagtgtcgctgaagtcttgccgaaattaggtccaaagataggttgggatttgagattcgaagaagacccatctgcctaa

SEQ ID NO: 436 - DNA, 978 bp, Saccharomyces cerevisiae
atgggcattttggactcgctgaaaaaacctgttaatatcaagagttcgctccccaaattctcccgcagtgctaccagcatcaatttaagtagccacccagtaagttcacggtccttcctcgaattaccaccagagcttttcagcatcactaaacctatatttaagcttctgcaagcacacgcaaataagatttacttccaatcttccgacgctgaggctgtatggaatgttaaggattcttctggacatgtttttgaagcagagtcaatttctttgctcggctctcatataattatcacaaattcctctgtacaagtcgcagacgtggccatcatagattccccttccaacataaaccaatgtgaaatttcaagcgttggagagttcctgcaattcaataatggccaactatctatcacatgtaacgattttggtttactggagaagttcaaaaggttgtgtatgatttctatttttgagttcatttctatatataaggccttgacaggcacagtgatttcctcttatgggctgagaatgtctgatatgcatatcattttgaactcgccgttcaattttaaggattggtgtgaagtttatcttgatggtcaaggttgggtgaaagtgtggtgtcatattgataaagtgtctaaaaccaataattctaaaagtagtagtgacaatgatgctaaaggaaagtatcaaatacggttttatagagatgacaaatccacatctagcaagaactgcgttttttttattcctgacaatgagtacgttcaagatattttcttttataacatcaatgcggcagaaccttctaaaaatatgaacgacttttttcaagggttgcaaatgataaagctcgttggtaatgtacgcttttgcagtgatacggactttaatgatgtggtggatagtggatccatctatagtagtgcaaacaacggcagtgtgacagcagctcgacagcattga

SEQ ID NO: 437 - DNA, 2271 bp, Saccharomyces cerevisiae
atgtataatagcagcaccaatcatcatgagggtgcacctacttcaggacatggctattatatgtcccaacaacaagaccaacagcatcaacaacaacaacaatacgccaacgaaatgaatccgtatcagcaaattcctagaccgcctgctgcaggatttagtagcaactacatgaaagagcaaggctctcatcaatcgttacaagagcatttacaacgtgagacaggtaaccttggcagcggttttacagacgttccagccctgaattatccagccacaccaccaccacataataattacgcagcttcaaatcagatgatcaataccccaccgccgtcgatgggtggtctttatagacataataataattcccagagcatggttcagaacggtaatgggagtgggaatgcacaattaccccaattatcaccgggccaatattctatagagtcagagtacaatcaaaatttaaatggcagttcttctagtagtccgttccaccaaccgcaaacgctacggagcaatgggtcatattcaagcgggttaaggagtgtgaaaagcttccagaggttacaacaagaacaggaaaatgtccaagttcagcaacaactttcccaagcacagcaacaaaattcccggcaacaacagcaacaacttcaataccagcagcagcaacaacaacaacaacaacagcaacatatgcaaatacaacaacaacaacagcagcaacaacagcagcagcaatcacaatctcccgttcagagcggctttaataatggtaccatatcaaactatatgtactttgaaagacgaccagatttgttgactaaaggaacgcaagataaagcagcagctgtaaagttgaagattgagaacttttaccaatcctctgttaaatacgccattgaaagaaatgaaagaagagtggagttagaaacagaactaacttctcataattggtcagaagaaaggaaatctaggcaattgagttctttgggtaaaaaagagtcacaatttttaaggctgcgtagaacgagattatcgttagaagatttccacactgtgaaagtcattggaaaaggggcatttggtgaagtcagactggttcagaagaaagacaccggaaaaatatatgcaatgaaaactttattaaaatccgaaatgtacaaaaaggaccaattagcacacgtcaaggctgaaagggatgttctggctggaagtgattctccatgggtggtttcgctatattactcattccaagatgctcaatacttatatttaatcatggaatttttgcccggtggtgatttgatgaccatgctaatcaggtggcaactatttacagaggatgttactagattttacatggctgagtgtattttggccatcgaaaccattcataaattaggattcattcacagagatattaaaccagataatattttgatcgatattagaggtcatataaaattatctgatttcgggttgtctacggggttccataaaactcacgactcaaactactataaaaagcttttgcaacaagatgaggcaactaatggtatttccaagccaggtacttacaatgcaaatacaaccgatactgcaaataaaaggcaaacaatggttgtggattctattagtctaacaatgtcaaacaggcaacaaattcagacatggagaaaatcacgtcgtttaatggcatattctaccgtaggtacaccagattatattgctcctgagatatttttataccaaggttatgggcaagagtgtgattggtggtcacttggagcaattatgtacgagtgtctgattggttggcctccattctgttccgaaactccacaggaaacgtacagaaaaatcatgaattttgagcaaactctacaatttcctgatgatattcatatctcttatgaagccgaagatctaatccgtcgactattaactcatgcagaccaaagacttggtagacatggtggtgcagatgaaataaaaagtcatccattttttcgcggtgttgattggaatacaatcagacaagtagaagcaccgtatataccaaagttgagctccatcaccgatactaggttcttcccaaccgatgagttggagaatgttccagattccccagctatggcacaagctgccaaacaaagggaacagatgacaaagcaaggtggaagtgcgccagtcaaggaagatttaccttttattggctacacttactccagatttgactatttgacaagaaaaaatgcgttgtag

SEQ ID NO: 438 - DNA, 2646 bp, Saccharomyces cerevisiae
atgtcgcaagaagaagcagaatccagtattatttatgaggaacccattgatattccgttagaggatgatgacgatgaggatgaactggaagaagaaaatagcgtacctttaagcagccaggcggatcaagaaaatgcggagaatgagtcagacgatagtgtcgataacgtagttggatctgagacacccagaagtgtaacaggtctttctgttgacccaagagacgttgcagacgaagaagatgaagatgaagaaggggaagacgaagatgaagacgaagacgacaatgatgttgacaatgaggacgaaaatgataatgataatgccaacgaaaatgaaaatgaattagggagctctagagataagagggcaccacctgctgtgcagactagtaaacgttataagaaatatccgaagctagatcccgcaaaagcacctcccgggaagaaagtcccgctacatcttttggagaagaggagactaggacgtattaaagctgctgaagaatttgccaagacgttgaaaaaaattggcattgagaaagtggagacaactactttacctgccactggcctgttccaacctttaatgttaatcaaccaaaaaaactactcatcagattatctgaaaaaagacgatcaaatatttgcacttagagatagaaaatttttgagaaataacaacactagccaaatatctagtaccaacacaccagatgttatagatttaaagagtttgccccactcagaagcgagtgcagcaccacttaatgacgagatagatctaaatgatccaacagcaactatcgtgatacatcctggatcaaattctataaagataggatttcccaaagatgaccatcctgtcgtagttccaaattgtgtagcggtacctaaaaaatggctggatcttgaaaatagtgaacatgttgaaaacgtttgccttcaaagagaacagtcagaagagtttaacaacataaagtcggagatggaaaagaattttagagaacgtatgaggtattataaaagaaaggtaccaggtaatgctcacgaacaggtagtatctttcaatgaaaattccaaacctgagattatttcagagaaaaatgatccatctcctatagaatggatatttgatgactcaaaattatactatggttcagatgcattgaggtgcgtggacgaaaaatttgttattagaaagcctttcagaggtggctcttttaatgtcaagtcaccatattataaatcgttggcagaattaatctcagacgttaccaagcttttggagcatgcacttaactcagagactttaaacgttaagcctaccaaatttaatcagtacaaggtcgtgttggtgataccagacatattcaagaaaagtcacgtagagacgttcattagagttctactcaccgagttacaatttcaagcagtcgctattatacaagaatcattagcgacttgttacggtgccgggatcagtacctccacatgcgtagtaaatataggcgctgctgaaaccaggatcgcctgtgttgatgaaggaacagttttggaacatagtgcaattacgttagattatggtggagatgatattacaaggctcttcgctctatttttgctacaaagtgatttccccctacaggattggaagatcgattctaaacatggatggcttcttgctgaacggctgaagaaaaatttcaccactttccaagatgctgatgttgccgttcagttgtacaattttatgaaccgctcacccaatcagccgactgaaaagtacgaattcaagctgttcgacgaagttatgttagcaccattggccttatttttcccacaaattttcaagttgatacgaacttcctctcacaagaattccagcctagaatttcagttgcctgaatctcgtgacctctttacaaacgaattgaatgactggaactccttgtcacaattcgaaagcaaagagggaaatttgtattgtgatttgaatgacgatctcaagatcttaaacagaatattagatgcccataacataattgatcaactccaggataagcctgaaaactatggaaatactctaaaggaaaattttgcacctttagaaaaggctatcgttcaaagtatcgccaatgcatctataacagctgatgtaacaagaatgaactcattttattcgaatattcttatcgttggtggcagttccaaaatacctgctttagattttattttaactgatagaatcaacatttggaggccctctttgttgagttcggcatcgttcccgcaattttacaaaaaactgactaaagaaatcaaagatttagaaggtcattatgtaaatgcccctgacaagactgaagatgaaaacaagcaaattttgcaagcccaaatcaaggaaaagattgtagaagagctggaagagcaacatcaaaatattgagcaccaaaatggtaacgaacacatttttccagtgagcattatcccaccaccacgtgatatgaatcccgctctaataatttggaaaggtgcgagcgttttggcgcaaattaaacttgtcgaagaactgtttattacgaacagcgattgggatgttcacgggagtagaatcttacaatataaatgtattttcacgtactag

SEQ ID NO: 439 - DNA, 1248 bp, Saccharomyces cerevisiae
atgaaaaggtccacgttgctgtcgctggacgcattcgctaagaccgaagaggacgtacgagtccgcaccagggccggcgggctgatcactttatcgtgcatcttgaccacgttatttctgctggtgaacgagtggggacagttcaattctgtggtaacaaggccacaattggtggtggaccgtgaccgacacgcaaagctggagcttaatatggatgtgacatttccatcgatgccatgtgacctggtgaatctcgatattatggacgactctggagagatgcaactagacattcttgacgcagggttcacgatgtctaggttgaatagcgagggtcgccccgtgggagatgctactgagttgcatgtgggtgggaacggcgacggaaccgcgccggttaataacgatcctaactattgtgggccatgttacggtgccaaagatcagtcgcagaatgagaatctagcacaggaagagaaggtttgctgccaagactgtgatgcagtgagatcagcatacttggaggcaggctgggcttttttcgacgggaagaatatcgagcagtgtgaaagagagggctatgtcagcaagattaacgagcacttgaatgaaggctgcaggatcaaaggttctgcacaaattaacagaattcaggggaatcttcactttgcccctggaaaaccctaccagaatgcatatggacattttcatgatacttctttgtacgacaagacttcgaatttgaacttcaaccacatcatcaatcatttgagctttgggaagccgatccagtcccacagtaagttgttaggaaacgataagcgccacggcggcgccgtagttgccacttctcccttggacggacgccaggtgttcccggacaggaacacacactttcaccagttctcgtattttgccaagattgtccccaccagatatgagtacttggataatgttgtcattgagaccgcgcagttcagcgccacttttcattcccgacctcttgccggtggaagggacaaggatcatccaaacacacttcacgttaggggtggtatccctggtatgttcgtctttttcgaaatgtctccattgaaagtcatcaataaggaacagcacgggcagacttggtcgggcttcatcttgaattgtatcaccagcattggtggtgtcctagctgtgggcactgtcatggacaagctattctacaaagcacagagatcgatctggggcaagaagagccagtag

SEQ ID NO: 440 - DNA, 4140 bp, Saccharomyces cerevisiae
atggcacgaaatttaaggaatagacgcggtagcgacgttgaagatgcaagcaacgcaaaggttgggtatgaaacacagattaaagacgaaaatggcataatccatacaacaactcgctctttgagaaaaataaactacgcagaaattgagaaagtgtttgattttttggaagatgaccaggtcatggacaaagatgagacgcccgttgatgttactagtgatgaacatcataacaacaaccagaaaggcgatgatgaagacgatgatgttgatcttgtatcaccgcacgaaaacgccagaacgaacgaagagcttactaatgaaaggaacttgagaaaaagaaaagcgcatgatccagaagaagatgacgaaagttttcatgaggaagatgtcgacgatgatgaagaggaggaagaagcagacgaatttgaagatgagtatttggatgaagactcgaaggataacaaccgtcggcgcagagcggccgataggaaatttgtagtaccagaccctgatgacgatgaagaatacgatgaggatgacgaagaaggagacagaataagccattcggcttcttctaaacgtttgaaaagggcaaattctcgaagaacaagatcgtcacgtcacccagaaactccaccaccggtaagaagagctttaagaagtaggacaagacattcgcgtacttcaaatgaagaaaatgacgatgagaatgataatagcaggaatgaagcgttaactttagctgatgaaattagagagttacaggaagatagtcctatcagggaaaaaagatttcttcgcgaaagaactaagccggtaaattacaaattaccaccaccactaactgctagcaacgcagaagaatttatagataagaataacaatgcactttcttttcataacccatcacctgcacggcgtggtcgcggtggttggaatgctagtcaaaattctggtcccacaagaaggctttttcccactggtggaccttttggtggcaatgacgtaactacaatatttggtaagaatactaatttttacaaccaagtcccatctgcattcagtgataataacaacaataaattaatactggattcagactcttccgatgatgagatattacctcttggcgtgacaccgaaaacaaagaaagagaacacgcaaaaaaagaagaagaaaaaaccagaaattgcagacctcgatccattaggcgtagacatgaatgtaaattttgacgatataggtggtttagacaactacattgaccaattaaaggaaatggtggccttaccactattatacccagaattgtatcaaaattttaatatcacgcccccaaggggtgttcttttccatggtcctcctggtacgggtaaaacacttatggcaagagcgttagcagcaagttgttcttctgatgaaaggaagatcacattttttatgcgtaaaggtgcagatattttatccaagtgggttggtgaagctgaaagacaactccgtttgttattcgaagaagctaaaaaacatcaaccttccatcattttttttgatgaaatcgacggattagcgcctgtgagaagttccaaacaagaacagatccatgctagtattgtttccacattattagcgctgatggatggtatggacaatagaggccaagtcattgtcatcggagccacaaatcgacccgatgcagtggatcccgcattaagaaggccgggaagatttgatagagaattttattttccattacctgatgttaaagcacgttttaaaattttgcaaattcagaccaggaaatggagttcaccgttgtcaaccaacttcattgataaattggcttttttgaccaaaggatatggtggtgctgatctgaggtccctatgcactgaggctgcactaataagtatacaaagaagctttcctcaaatttataggtcaaatgataaactcttggtggacccttctaagattaaagtcaaagttagcgatttcatgttagctttgaaaaaaattgttccgtcatctgcgagatctactggtagttctcctcagccactacctgaattaatcaaaccattactggcagatcaacttaataatttaaagaacaagctggattatatgctgaacattaaagacacaacttttcagagaaacacatcattgctacaaaatttcatcgattatgaagaatacagtggagaggaagaagagcatgacaaatatggaggaaatgaagatacatccagttttagatcatatgagtttttcgaatcgatggcggaatcacaaatttgtaaacctcggttattaataaatgggcccaagggaaatggtcaacaatatgtcggagccgcaattttaaattatttagaagaattcaacgtccaaaacctggaccttgcctctttggtttcggaaagttctaggactattgaagctgctgtagtgcaaagttttatggaagcaaagaaaagacagccctcagttgtatttattcctaatttagacatttggatcaacactattccagaaaacgttattttagtcttatcaggtttgttcagatctttacaaagcaatgaaaaaattcttctattatgcttagctgaaaatcttgatatatctgaagttaaaaatggtattttatctgattttgcttttgataaaaatatctttcaactgcataaaccatccaaagagaatataacgaggtatttttctaatttaattgaactactgaaaacaaagccaagtgatattcccatgaaaaagagaagagtcaaaccgttacctgaattacaaaaagtaacttcaaacgcagctccaacaaattttgatgaaaatggtgagccactgtctgaaaaagtggtattaagaaggaagttgaaatcttttcaacaccaagatatgagattgaaaaatgtgttaaaaatcaaactctcaggcttgatggatctttttaaaaacagatataaaaggtttagaaaaccacctattgatgatgccttcttggttcatcttttcgaaccagagacaagcaatgatcccaattggcaacctgcatatataaaagatgagaacatgattctggaggtttcaacagggcgaaagttttttaacatggatttggatattgtcgaagagagactttggaatggctattactcagaaccaaaacagtttttaaaagacattgaactgatatacagggatgcaaataccattggggacagagaacgtgtcattaaggcctctgagatgtttgccaacgcgcaaatgggtatcgaagaaatttcaaccccggattttattcaagagtgtaaagctactcgccaaagggatttggaaaggcaggaacttttcttagaagatgaagagaaaagagctgcaatggaattagaagccaaagaacagagtcaagaaaatatactgcaagaacctgatttaaaggataacaaggctaatgagtttggtgtagctgctggtaatcaattgcaagctcagctgcaaacaactatcaatacagcctctatcgttaataacagcgaggtccctcaaccaattgataccaacctgtataaaaaggagattcctgcggcaattccctctgcagtagataaagaaaaagcggtcatccctgaggatagcggtgcaaatgaagaatacacaacggaactgatacaggccacttgcacgtcagagataaccaccgatgatgatgaaagggccagaaaagaaccaaaagagaatgaagactctttgcaaacgcaggttacggaagaaaacttcagcaaaatagacgctaatactaataatataaatcacgtaaaggaaattcaatcggttaacaaaccaaattccctccacgaaacggtagaaaaaagggaacgaagtccgataccaaaagaggttgtggaaccggagcaagggaagaagagcgacaaggagcttattttgacgcccgaacaaataaaaaaagtatctgcatgcttaatcgaacactgtcagaattttacggtttctcaattagaagatgttcattcgtccgttgcaaaaataatatggaaaagtaaatcagcatgggataaaacaggaactgtcgatgaaataataaaatttttatctgaataa

SEQ ID NO: 441 - DNA, 897 bp, Saccharomyces cerevisiae
atgtcagcactgtactttcaaaatttacccagtaggccagcaaataaagaaaattataccagattacttctgaaacacattaatcccaacaacaagtatgccattaatccgtcgctaccccttccccacaataaattacaaatatcatcacaaccgctgatgttactagatgatcaaatgggccttcttgaagtttctatttcaagatcatcaaagatgactaaccaagcatttttaacgtttgtcactcaagaagaagcagaccggtttctagaaaaatacacgacaacagcattaaaagttcaaggtcgtaaagtgagaatgggaaaggctcgaacaaattcgttattgggtctttcaatagaaatgcaaaaaaaaaaaggtaatgacgaaacgtacaaccttgatataaagaaggtgcttaaagcaaggaaacttaaacgcaagttacgtagtgatgatatatgcgccaaaaagttcaggcttaaaaggcaaataagacgcctgaagcataagctgagatcaagaaaggtagaggaggctgagattgataggattgtaaaagaatttgaaacccgtagattggaaaacatgaagtctcagcaagaaaatctaaaacaatcgcagaaacctcttaagcgggctaaagtgtccaatacaatggaaaatccaccgaacaaagtccttcttatacaaaatttgccaagcggcactaccgagcaattattgtcgcaaatacttggcaatgaggctttagttgaaatcagattagttagcgttcgtaacctagctttcgtggaatacgagaccgttgctgatgctacgaaaatcaagaatcagttaggctccacttacaagctacaaaacaatgacgttaccataggatttgctaagtag

SEQ ID NO: 442 - DNA, 2115 bp, Saccharomyces cerevisiae
atggtttctccaacgaaaatgataataaggtctccgttaaaggaaacagataccaacttgaaacataataatggaattgccgcatcaacaacagcagcgggccacttgaatgtgttttctaacgacaataattgcaacaataacaataccactgaatcctttccgaagaaaagatctcttgagcgcctcgagctccaacagcagcagcatttgcatgaaaagaaaagggccagaatagaaagggccaggtctattgaaggcgctgtccaagtcagcaaaggtacgggtctgaaaaatgtcgagccaagggttacgcctaaggaattgctggaatggcaaacaaattggaaaaagataatgaaaagagattctcgcatttactttgacattactgatgatgtagagatgaatacatataataagtccaagatggacaaacgcagagatttattgaaaagagggtttcttacattgggtgcgcaaataactcaattttttgacactactgtcacaatagttatcacaagaaggtctgttgagaacatatatttactaaaagataccgacattttatcgagagctaaaaaaaactacatgaaagtttggagttacgaaaaggctgccagatttctgaaaaatcttgatgttgatttggatcatttgagcaagactaaatctgcttctttagctgcgcccacattgtccaatcttctacacaatgaaaaattatatggaccaacggatagagaccccagaactaaaagagacgatattcactactttaaatatcctcatgtatacctttatgacctatggcaaacttgggcccccataataactttggaatggaaacctcaagaactaacaaacttagacgaactaccttacccaatattgaaaataggttcattcggaagatgcccttttataggggataggaattatgacgaaagttcttataagcgcgtagtaaagagatactcgagagacaaagcaaacaaaaaatatgcactgcaacttcgtgctctatttcaatatcatgccgacaccttactgaatacgtcatcagttaatgatcaaacgaaaaacctaatattcatacctcacacatgcaacgattctaccaagagcttcaaaaaatggatgcaagaaaaggcaaaaaattttgagaagaccgagttaaagaagacggatgatagcgcagttcaagatgttcgtaatgaacatgctgaccaaaccgatgaaaaaaatagtatattattaaatgaaactgaaaccaaagagcctccgttgaaagaagaaaaagaaaataaacaatctatagcagaagaatcgaataagtacccacagcgaaaagagctggctgccacaccaaaactaaaccatccagtattagctacttttgcaaggcaagaaactgaagaagtgccggatgatttgtgcactttgaaaacaaagtcacgtcaggcatttgaaatcaaagcaagtggtgcacatcaatctaatgatgtggcaacctcttttggcaatggtttgggcccaacaagagcaagcgtcatgagtaagaacatgaagtcattaagtagactaatggttgatagaaagctgggagtaaagcagacaaatggaaataacaaaaattatacagccactatagcaactactgctgaaacatcaaaggaaaatagacacagattagattttaatgctttgaaaaaagacgaagccccttcgaaagagacgggcaaagatagtgctgtacacttagaaactaatagaaagccccagaatttccctaaggtagctaccaaatcagtctccgcagactccaaagttcataatgacatcaagataacaaccacagaatctccaacagcatcgaagaaatcaacttccacaaacgtcaccttacattttaacgcacagacagcacagacagcacagccggtgaagaaagaaacggtaaaaaattccggatactgtgaaaattgtcgtgtaaaatacgaatctttagaacaacacatagtttctgagaagcatttgtctttcgctgaaaacgatttaaattttgaggctattgactcgttaattgaaaatctcagatttcaaatatag

SEQ ID NO: 443 - DNA, 1695 bp, Saccharomyces cerevisiae
atgtctagtgcgcaatcctctattgatagcgatggagatgttcgagatgctgatattcatgtcgcaccacccgtggaaaaagagtggtcagatggatttgatgacaacgaagtcataaacggggataacgttgagccaccaaaaagagggctcataggttatcttgtcatttacttactgtgttatccaatatcctttgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggccttatttttgcccgtcttgctgatactttaggtagaaggctggcaattgtgatcgtggtgttggtatatatggttggtgcaattattcagatcagttcaaatcacaaatggtaccagtactttgtcggtaagatcatctacggtcttggtgctggtggctgttcggtgttgtgtccaatgcttttgtctgaaatagcccccacagatttgagaggtggactggtctcattgtaccaactgaacatgacgttcggtattttcttgggttattgtagcgtttatggtacgagaaaatacgataacactgcacaatggagagtcccccttgggctttgctttttatgggctttgattatcatcattggtatgttattggttccagagtccccaagatatctgattgaatgtgagagacacgaagaggcccgtgcttccattgccaaaatcaacaaggtttcaccagaggatccatgggtactcaaacaggctgatgaaatcaacgccggtgtccttgcccaaagggaactaggagaagcttcatggaaagaacttttctctgtaaaaactaaagtccttcaacgtttgatcacaggtattcttgtgcaaacctttttgcaacttactggtgaaaactacttcttcttctacggaactaccatttttaaatcagtcggtcttactgatgggtttgagacgtcgatcgtcctaggtacagtgaacttcttctccactattattgctgttatggtcgtagacaaaattggccgtcgtaaatgtctgttatttggtgcagctgggatgatggcttgtatggtcatatttgcaagtatcggggtgaaatgtctttaccctcatggccaggacggtccttcttcgaaaggtgcaggtaatgccatgattgtgttcacttgtttctatatattctgctttgcaacgacatgggctcctgttgcttatattgtggttgccgagtcgttcccttcgaaggtcaagtctagagccatgtcgatttcaactgcatgcaactggttatggcaatttttgatcggttttttcacaccattcattactgggtctatccacttctattatggttatgtgttcgtaggttgtttggttgctatgtttttgtacgttttcttctttttaccagaaacgattggtctatctttggaggaaatccaattactatacgaagaaggtataaaaccatggaaatctgcatcttgggtcccaccttctaggagaggtatttcttccgaagaaagtaagaccgagaagaaggattggaagaaatttttgaagttctcaaagaattctgattga

SEQ ID NO: 444 - DNA, 2628 bp, Saccharomyces cerevisiae
atgtcaaacttttttagagatagttcaatgggattcaagcctcgaccaaacatcttcgctaagctgagagtcagagatgtagattcagattcttccgctaatactgttgtcgagaattcatccaactgtttagacgtgggttcttctatagagggagatgataccttcaaaaaaccccacaaaacttctaccgaacaagaactgattacaagtatgagccttagtcagagaaaccatggttattctgatgatatggaaataggttcaccaaaaaaaacaacatcaacagaccaatacaacagaattttaaaaaatgatgttgccgcaattgaaaatgatactgatgaagattttgaaattacagaagtaagagaagtgagtgaaggagtagcaaaagaaacgaaagaaagtcatggggatcctaacgattctgagacaactctcaaggatagtaaaatgcatgaatatactatgacaaatggaaaggctcctttgcacacgtccatcaataattctagtacatcttcaaatgatgtcctgttagaagccttcacaaacactcaaagaatatgttcaaatttaaagcaagagctacaaaagcagcaacaggataatgcaaagttgaaagttcgactacagtcgtatgcttccaattctgataagatcaatgaaaaagtcggaaaatataaatcttgtttagaaactcttcaagaaaggattgcaacgttgacgagccataagaataatcaagaaactaaattgaaagatttaagacaaaaccaccaactatatcagagaaggataagcggatttaagacaagtattgaaaacttgaacaaaacaataaatgatttagggaagaacaaaaaggaggcggatgcagaattaatgaaaaaaggtaaagagattgaatacctgaaaagagaactagatgattgttcaggtcagttgagcgaagaaaaaatcaaaaacagttccttaatacaggaaatgggaaaaaatagagaagaaatgattaaatcaattgagaatttcttttcagaagataaagcacaccatttactgcaatttaacaaattcgaagaaagagttcatgatttgtttgaaaaaaaattacaaaagcacttcgatgtggcaaaagatacccttaacgtaggcttgaggaacaccactgtagagttgagtagtaatacagagaccatgctaaagcagcaatatgaagatatcaaagaaaatcttgaacaaaaaatgtcatccagtaaggatgaaatggcaaaaacaataaatgagctgagtgtaacgcaaaaaggacttataatgggagtacaagaagaactattaacgtcatcagggaatattcaaactgctttggtaagtgaaatgaataacacaaggcaagagcttcttgatgatgcgtctcaaacagccaaaaattacgcgagtttggaaaacttggtgaaggcatataaggcagaaatagttcagtcgaatgagtatgaagaaaggataaaacatttggagagtgaaaggtcaactttgtcttcacaaaaaaatcagattattagctctcttggtactaaagaagcacaatatgaagatttggtcaaaaagttggaggcgaagaatatcgaaatttcacaaatttctggcaaagaacaaagtttaactgaaaaaaatgaaaacctttctaatgaactgaaaaaagtccaggatcaactagaaaaactcaacaatttgaacatcacaacaaaatcaaattacgaaaataaaatatcttctcagaatgaaattgtgaaggctttagtttccgaaaacgacactctgaagcaaagaattcaacagctagtagaaatcaaagaaaatgaacagaaggatcatacaaccaaactggaggctttccaaaagaacaatgagcagctacaaaagctaaacgtcgaagtagtacaactgaaggctcatgaattggagcttgaagagcagaataggcacttaaaaaattgtttagaaaaaaaggaaactggtgttgaagaatcactaagcgatgtaaaaaccctaaaacagcaagtgatagttctgaaatcggagaagcaagatataacagctgaaaagttagaacttcaagataacctcgaaagtttggaagaagtcaccaaaaatttacagcaaaaggtgcaatcgcaaaagagggaattagaacagaagattaaagagctagaagagataaaaaaccataaacggaacgagcctagtaaaaaaggtacacaaaattttactaaaccatcagattcacccaaaaaaaatgctacgacgtccaacttatttcctaataactctgctgccattcactctcctatgaaaaagtgtcctaaggtggatcatataagtaagtcaagaattaattcatccaaagaaacatccaaatttaacgatgagttcgatctttcttcatcatcaaatgacgacctagagttaaccaacccttccccaatccaaattaaaccagtgagaggaaaaatcaagaagggttcaaattgcatgaaacctccaatttcttcaagaaaaaaattactactagtagaagacgaagaccagtcattaaaaataagcaagaaaaggagaaggaaatag

SEQ ID NO: 445 - DNA, 2529 bp, Saccharomyces cerevisiae
atgataaatgagagcgtttccaagagagaaggattccacgagtctataagcagagagacgagtgcaagcaacgctttaggactatacaataaatttaacgatgagcgaaatcccaggtatcgaacgatgattgctgagctgcacgagttttttcaccttactttagctgaaactataactgaaactgacgtgaaagaattggagtgtaataaagaaaaggccgctaaatttagaaagctaatgcctaagatgttgaacaattgccgtgaattaacgcaaaggaaatcatacattccttacaactcagaatttaatgggaatgacgaaaagcaaaagaagtttcagctgctacatcaacaccaaattgtgctgagttttcaagaattttgtgatgaattggcaaagttaataattgacgcgcacgtccttagctttttgaccagatgcgactattcttatgaaattatacccaaaaattggacctctttttacaagctatttcagtacgtaatgggtgccgttggtcctattatatcgtatgtgccggtaaattatcccatgataagaaaagaactaggatttgagaccttaacgatatttcagtattatgattccaaacttttcgaatgtatgaagtcacattttggaagggaattttccacccttgtaagcgctactattcatcactatattcatatgtttccaataacgaatacaatgttagagaaggaagttcctatgctccgtataatgtctaactgcaattttagtatagagggcttgagccccaaagatttttatatgaaaactctcagacaatattactgtgaggaatcaaatttaaggccgaggctggaaactttcaagaattttaaggtactattgacgaggaatgcattattagcatctttattttcccctgaatgggtcagcgatgcaaatgacctatttataagccatctactgttgaacaagaagtctattagcgaatacatagaaattgggaaggacacttatgatgaagaaaaagagagatatttcaaaactgagacacactttagcttattgatgtttagaaatgcttttgaagcaaaaaatatgctgtcaaaattcaaggaattctgtgatgatgccgtttcagaaaagttaaaggcagcatatggatccaatcatgatactgaaaggctatttgatgaggtagttcagctagctaatgtagatcacctcaaaatatactccgattccatcgagtaccatttatgtaatttacttggaagtaccagcaaagccatagaacagtatgtcaaatattttgagtcacatttattcatcatcgtcagaaagataaaaacaactaaaaaagacctacccagagatatgaaaataaagtatctcaacgaaaatcttcctatattgagactgaagttcgttaaccttcccacatttcctaattttttcgaaagatcaattttcagaaagacgatcttacaaagtgatcaaaattcctcatttattaaggatatattacctgtttacaaagacagcctcatggaacttttcaaacaaagaatcataacaaatgtctcacaagaggatgaaatgcgataccgagatcaatatcaaccctatttatcgcaattctttcagccggtagaggttatggcagatctgagaatcaaatatgcatcgttcttgtcgttttatgagaatatcgaggctgctgtgaagttcgggaagacatacaatgaaaacaacagcaagtcatttttcccacttatctttgatagagaaagaattcccaaagtttttcagcaatccaacgaagtaaagaaaaattttgtcctacctcaagagatggatgatacgtggaaccaatttctccgtaattatcacgagcagaataaagtggaagattcagatgcttccaaaaaagagctatatccgatgtggaacttgcaccactgcgaagtggagtcgccttatatcatacaggatggaactaacctaatatttgaattgacccttttccaaacatgtgtgctgactttattcaacgaaagcgatcatttgaccttgcaagttatatcagagcaaacgaaactggcgtacaaagacttagcgctagtcttaaaatccttctgcaattataaaattctgacaagagatattgacaacacatacagtatcaacgagagcttcaaacctgatatgaaaaaagtgaaaaatgggaaactacgtgtggttctaccgagaaccgcgtctctccaaagtagcaacacaggcggtgaaagaaccagttctgcacaccacgaaggaagtaattcccaatggacccaagaattactaaaggcatgcataactagatccgttaagagcgagaggaatgggctagactacgaccatttatttgaaacggtaaagcagcagataaaaggctttagtgttggtgagttcaaagacgccttggccaagttgttacgagacaaattcataactagggacgaatcaacagcaacttacaagtactaa

SEQ ID NO: 446 - DNA, 4557 bp, Saccharomyces cerevisiae
atgactggtcacgtttcaaaaacgagccacgtacccaaaggtcgcccgtcttcattggccaagaaggcagctaaaagggccatggccaaagtaaattcgaatccaaaaagggcgtcggggcatttggagcgtgttgtacaatctgtgaacgacgctaccaaaagattatctcagcccgactctaccgtaagtgttgctacaaaatcatcaaagagaaaatccagagacacggtgggtccttggaaacttggcaaaacattggggaagggatcttctggtagggttcgcttggctaaaaatatggaaacaggacaattagctgccattaaaattgtccccaagaagaaagcctttgttcattgttctaataatggaactgttcctaattcttactcttcttccatggtcacttccaatgtatcttctccatcaatagcatctagagaacatagtaaccattctcaaacgaacccatatggcatagagagagaaatagtaatcatgaaattgatatctcacacaaacgttatggcattgtttgaagtttgggagaacaaatcagagctgtacctagttttggaatatgttgatggtggcgaattattcgattatctggtctcgaagggaaagctacctgaaagggaggctatccattacttcaagcagatagttgaaggtgtttcctattgtcattcttttaatatatgccatcgtgatctgaagcctgaaaatttattattagataaaaagaataggagaatcaaaattgctgatttcggcatggcagcattagagcttcctaataaacttttaaaaacttcatgtggctctccacactatgcgtctcctgaaattgttatgggtagaccatatcatggcggtcctagcgatgtctggtcctgcggtatcgttttatttgcattactcaccggtcatttaccatttaatgatgacaacatcaaaaagctgttgttgaaagttcaatcgggcaaatatcaaatgccctcaaatttatcttctgaggctcgtgatttgatatcaaaaatattggtaattgatccagaaaaaagaattaccactcaagagatattgaagcatcctctgatcaaaaaatatgatgatctcccagttaataaagtgctgaggaaaatgagaaaggataacatggcgaggggaaaatctaactcggatttgcatttgctaaataatgtctcgccctctattgtaactttacattcaaaaggggaaattgatgaatccatcttgaggagtttgcaaattttgtggcatggagtttctcgtgaactaatcactgccaagttgcttcaaaagccaatgtcggaggaaaaactattctactcactgttattacaatataaacaacgtcactcaatatcattgtcctcgtcaagcgaaaacaagaaatcagcaacagaaagtagcgtaaatgaacctaggattgaatacgcatccaaaactgccaataatacaggcctaaggagcgagaacaatgatgtgaagactttacattctctagaaattcattcagaagatacttcaacagtgaatcagaacaacgcaattacaggggttaatacagaaattaatgcccctgtattggcacaaaaatcgcaatttagtatcaatacgctcagtcaacctgaaagtgataaggctgaagcagaagctgtaacattaccacccgctattcccatattcaatgcttcttcatcaaggattttccgtaactcatacacctctatttcatcacgttcgagaagatcgctacgcttatcgaattccagattatcattgtccgcttcaacttctagagaaactgtgcatgataatgagatgcctctacctcaactgccgaagtcgccttcaagatattcattgtcaagaagggcaatccacgcctccccatctactaaatcaatacataaatcactttcgaggaagaatatagctgcaactgttgccgctagaagaacactacaaaactcggcttcaaagagatccttatactcattacagtcaatttcaaaacgttccttgaacctgaatgatttattagtctttgacgatcctctccctagtaagaaaccagcatccgaaaatgtgaataaatcagaaccccattcgttggaatcagactctgattttgagatcttatgcgatcagatcttatttggaaacgccttagataggatactcgaagaggaagaggacaatgaaaaagaacgcgacacccaaagacagaggcaaaacgatacaaaatcttcggcagacacttttacgatctctggggtgtctacaaataaggaaaatgagggcccggagtatccaaccaaaattgagaaaaatcaattcaatatgtcatataaaccatctgagaatatgtcagggctctcttcatttcctatctttgaaaaagaaaacacgttaagctcaagttatttggaagaacagaagccaaagagagcggccctttcagatatcacgaactcattcaataaaatgaataaacaggaaggtatgaggatagaaaaaaagattcaaagagaacaacttcaaaaaaaaaatgaccgcccgtcaccactcaaacctattcagcaccaagaacttcgtgtaaattctttgcctaatgatcaaggtaaaccgtccttatctctagatccccgccgtaacatctcccagccagtgaattcaaaagtggaatcactattgcagggactgaaattcaaaaaggagccagcctctcactggacccatgagagaggttccttgttcatgagtgaacatgtggaagacgaaaaaccagtcaaagcctcagatgtttcaatcgaaagttcatatgtacctttaacaacagtagcaacatcttcgagagatcccagtgttttagcagaatctagtacaattcaaaaaccaatgctgtctttaccttctagttttttgaacacatctatgacgttcaaaaatcttagccagatactcgctgatgacggtgatgataagcatctaagtgtgccacagaaccaatctagaagtgtagccatgtcacaccctttgcgaaaacaatctgccaaaatatctctaactccacggtctaatttgaacgccaatttatccgttaaacgtaatcagggctcacctggctcctatttgagtaatgatctggatggaatctctgatatgacatttgcgatggaaataccaacaaacacctttaccgctcaggcgattcaactgatgaacaacgacacggacaataataaaatcaatacttcgcccaaagcatcttcttttacaaaagaaaaagtaatcaaatcggcagcctatatctcgaaggaaaaagaaccagataatagcgatactaattatattccagattatactataccaaacacatatgatgaaaaagccattaatatttttgaagatgcgccctccgatgagggttcattaaatacatcttcttcagaaagcgattcacgagcaagtgtgcataggaaagcggtatctattgacactatggcgacaacaaacgttcttactcccgcgacaaatgttagagtaagtctttattggaataataacagttctggtatacccagagagactactgaagagatactttctaaacttagattgtcaccagaaaatccttctaatacacatatgcaaaagaggttttcttccacgcgtggtagtcgtgatagtaatgcattaggcatttctcaaagtttacagtcaatgttcaaagatttggaggaagatcaagatgggcatacttctcaagctgatattcttgaatcaagtatgagctattcaaagcgaagaccatctgaggaaagcgttaatccaaaacaacgagtgacaatgcttttcgatgaggaggaggaagaatctaaaaaagtaggtgggggaaaaattaaagaagagcataccaagctagacaataaaatatccgaggaatcttctcaacttgtgttgccggtggttgaaaaaaaggaaaatgcaaataatacagaaaataactactctaaaataccaaaaccctcaacgattaaagttacgaaggataccgctatggaatcaaatacacaaacccatacaaaaaagccaattctaaaaagtgtccaaaatgttgaagttgaagaagcgccttccagtgataaaaagaattggttcgtcaaactatttcaaaacttttcttctcataataatgctactaaggcatccaagaatcatgtaacgaatatatcatttgatgatgcgcatatgctaacattaaatgaattcaacaagaatagtatcgactatcaattaaagaacctagatcacaaatttgggagaaaggtggtggaatacgattgtaaatttgtaaaaggcaacttcaaattcaaaatcaagattactagcacacccaatgcatcatcggtaattactgtaaaaaaaagaagcaaacattcaaacacaagttccaataaagcctttgaaaagtttaatgatgatgtggagagagtaattcgaaatgccggacgttcataa

SEQ ID NO: 447 - DNA, 2532 bp, Saccharomyces cerevisiae
atgacggacgttgaaggctaccaacctaagagcaaggggaaaatctttccagatatgggtgagtcctttttctcatcagatgaggattcaccagctactgatgcagagatcgatgagaactatgatgataacagggaaacgtcagaaggacgtggagaaagggataccggcgccatggtaacagggttgaagaagcctcggaaaaagaccaagagtagcaggcatacagcggcggattcctctatgaatcaaatggacgctaaggataaagcgcttttgcaggacactaatagcgatataccagcagatttcgttccagattccgtctctggaatgttcagaagccatgactttagttatttgcggttaagaccagaccatgcttccaggcccctttggatctcgccaagtgacggtaggatcattctggagagtttctctccattagcagaacaggctcaggactttctggtcaccattgcagagcctataagtagaccctcccatattcatgaatacaagatcacagcatactctttgtatgcagctgtttctgtagggttggagacggatgatatcatttcagttctggatagattatccaaagtacccgttgctgaatcgataatcaacttcattaaaggggctaccatttcatacggtaaagtgaaactagttattaagcataatagatatttcgtggagactacacaagcagatattctgcaaatgttgctgaatgattccgtcatcgggcccctaagaatagatagcgatcatcaagtacagccaccagaggatgtactacagcaacaacttcagcaaaccgctggaaaacccgctactaatgttaatccgaacgatgtggaagccgtgtttagtgcagttataggtggtgataatgagcgggaagaagaagatgatgatattgatgccgttcactcctttgaaattgccaatgagtctgttgaagtcgtaaagaaaagatgtcaagaaatcgattatcccgtgttggaagaatacgactttagaaacgaccatagaaacccggatttagatattgatttgaaaccttccactcaaatcagaccctatcaagaaaaatcgctgagtaaaatgtttggtaatgggcgtgctcgttcagggattattgttttgccatgtggcgcaggtaaaactttggtcggtattaccgcagcatgtactataaaaaaatccgtaattgttttatgtacttcatcagtctccgtcatgcaatggaggcagcaatttttacaatggtgtaccttacaacctgaaaattgtgctgttttcacctctgataataaggaaatgttccagacagaatccggtttggttgtttccacttattcaatggtggcaaacacaagaaacaggtctcatgattcacaaaaagttatggatttcttgaccggtagggaatgggggttcattattcttgacgaagttcatgtggtgcccgccgcaatgttccgtagggtggtctccaccatcgcagcacacgccaaattgggactgaccgcaacgctggttagagaagatgataaaattggtgatctgaattttttaattggtccaaaactttatgaagcaaattggatggaattatcccaaaaaggacatattgcaaatgtccaatgtgcagaggtttggtgtcccatgacagcagaattttaccaagagtatttaagagaaactgcaaggaaaagaatgctactgtatatcatgaatccaacaaagtttcaggcatgccaattcttaattcaatatcacgaaaggaggggtgataagatcatcgttttttcagataatgtttacgccttacaagaatatgctttgaaaatgggaaaaccatttatttatggttccacaccacaacaagagcgtatgaacattctgcaaaatttccagtacaatgaccaaatcaataccatatttctatcaaaagttggtgatacttccatcgatttaccagaagctacctgtttaattcaaatatcttcgcactatgggtctcgtcgtcaagaagcccaaagattaggaagaattttaagagctaaaagacgtaatgacgaaggtttcaatgcgttcttttattctctggtttctaaggatacgcaagaaatgtactactcaacaaagagacaagcgtttttggtagatcaaggttacgcattcaaagtcattacacatttacacggaatggagaacattccaaatttggcatatgcttcacccagagaacgtagagagctattgcaagaagtattattgaagaacgaagaagctgctggtatcgaggtcggtgatgacgctgacaattctgttgggagaggttcaaatggccacaaaagatttaaatcaaaggccgttagaggtgaaggttcattgtctggtcttgctggcggtgaagatatggcatatatggaatacagtaccaataaaaacaaagaactgaaggaacatcatccattaatcagaaagatgtattataagaatttgaagaagtga

SEQ ID NO: 448 - DNA, 1359 bp, Saccharomyces cerevisiae
atgggtagaagaaaaattgaaattgaacctatcaaagatgatagaaatcgtacagttactttcataaagcgaaaagcaggactatttaaaaaggctcatgaattgtcagtactttgccaagtagacattgctgtcattattttaggatccaataatacattctacgaatactcttctgttgatatgagtaacctgcttaatgttcatcaaaacaacactgatcttcctcataatatcatagaaccatctgattatggtgactatgtgaaaaaaccacgtgttgttctgaatgaaaggaagcgcaggcgaagaagagcaaccgtgttgcaaccagcttcccattctgggagttgtacagtttcgagtcaagattcctccagtgtacaaaacaatgggaatttaagcgctccgttggcgtcaaatgacgccgggaacgctggtgtaagtacaccattggtgcattgccacggagcaatatcacgtagcggatccaatcattctgactgtgcaagaaatagtgcagattatcaaatgttgcaaggcggtttaaattctggtgggagttttcatgctaatgattataaagaaagcgtagaccaacagcatgttgcaaacgaggctattcataggaattttatgaacaagaggattaggccggatactcatttactactttctgaatctaaccactctaattatcataatttttacccgtcgccttacgagaatttgccaaagccttcattgcctgcaagtttagtgggcaatattccatcctttcaatcgcaatttgtacaggttattccggcaaatagtaacccaatgggaaaaggatttaatgggacgggtgacagcgagagctttgaagcaaagcaaaagatacacccgacagttgctatatcaaatactttggaaggtccagctccagtgcaggcgatggtccatcacctgcaccaactgaacagcaatagaggaaagctctcagggaagccatatttaaagctaaatattccgaaggccacaaatgacgcttgccagaggtcgccagcaatgtattcaggaaccgcatcaccgaaaacggatgtacaagccactcccaatcaaatgctcgccagcaacatgtcctcccctctttctcgttcaaagtttttgggattcaagaacaatgatatggacgacttatatcataatggccgatgtggcagcacttatgtaaataacaaaacattctttctgaaaccgccaattggaagaccgcctaaatttccgaaaagcccgtcttcatctattgtggtttttccttcctcggtagctagttcaactttgaaatccacgagttcgacaaactctccagattaa

SEQ ID NO: 449 - DNA, 369 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacgtttgttgaagacgaaccagatttccagggcggaccaatcccttcaaacaaaccacgtgatggtctacacgttgtttcaagtgcatactttgaaattcaatag

SEQ ID NO: 450 - DNA, 765 bp, Saccharomyces cerevisiae
atgaaggcctgttccatattatttaccaccttaattactctagccgctgctcaaaaagactctggttccttagatggccagaactctgaagatagctcacaaaaggaaagctcaaactctcaagagatcacacctaccacgacaaaggaagcccaagaaagcgcatcaactgtagtttctaccggaaaaagcttagtacaaactagcaacgtcgtcagcaacacctatgctgtggctccaagtaccaccgtagtgacgacggatgcacaaggcaaaaccacgacacagtacctatggtgggtggccgaaagcaactctgccgtaagcacaacttcaactgcctctgtgcagcccaccggagagacgtcaagcggaatcaccaactccgcatcctcctcaacgacatcaacatcaacggacgggccagttactatagtaactaccacgaattcgttaggtgagacttacacatctactgtttggtggctaccgtcctcagccacaactgacaacacggcttcatcaagtaaatcatcttcgggatcctcatcaaaaccggaatcaagcaccaaggtagtaagcactatcaaatcaacttataccactacgtcaggttctacagtagagacactgaccactacatacaagtctacagtcaacggtaaggtagcgtccgtaatgtccaattctaccaatggcgcctttgccggcactcacatagcttatggtgcgggtgcattcgccgttggtgcccttttgttatag

SEQ ID NO: 451 - DNA, 612 bp, Saccharomyces cerevisiae
atgacaccaccgatgtgttcgaattccttcttcaaccattcgtcatcaatagaccacgatagtctaccaacgaaaatagtagctggttcttcggtttcttcatttttttgcttcttgttggaagactcttcgtcttcttcttcttcggcgtcctcagatttacgtttcttatcgttagactcttccttttcgctttcgctatcagaagatgaagatgaggatgaatcagagctagaagattcttttgattcttccttcttggtttcttctttttcttcttcttcttcttcgtcggaagaagagtcagaggaagaggaagaggaatccttggattcttccttcttggtttcagcttcactttcgctgtcagaagacgatgaagaagaggattcagaatcagaggatgaagatgaagatgaagattcagattcagactcagactcagattcagattcagatgaagatgaagatgaggatgaagattcggaggaagaggaagagacggccttagctttttcttctttggcttgtttggaagccttaacttccttcttgttaccttttactttagtagtcttagccatcttattttatcctgcctgggttgagtga

SEQ ID NO: 452 - DNA, 3096 bp, Saccharomyces cerevisiae
atgggtgtgcattcattttgggatattgcaggtcctacggcaagaccggtcaggctggaatccttggaagataagagaatggcagtagatgcctccatttggatatatcagtttttgaaagctgtccgtgatcaggaggggaatgcagtgaagaattctcatattactgggttctttagaagaatttgtaagctattatactttggcattaggccggtattcgtctttgatggtggtgtgcccgtattgaaaagggaaacaatacggcagaggaaagaaagaagacagggaaaacgagagagtgcgaaatccaccgctaggaagctgctggctttacaattgcaaaacggctcaaacgataacgtaaaaaactctacaccgagtagtggcagtagtgtgcagatcttcaaacctcaggacgagtgggacttgcccgatataccgggattcaaatacgataaggaagatgcaagagttaactctaataaaacttttgaaaaactgatgaattcgataaacggtgatggactggaagacattgatttagacactataaatccagcatcggccgaatttgaagagctgccaaaggccacacagtatttgatattatcgtcgttgaggttgaaatcaagactgaggatgggatactcgaaagaacaattggagaccatcttcccaaatagtatggatttctcaagatttcaaatagacatggtgaaaaggaggaatttttttactcaaaagttaatcaacactactgggtttcaggatggtggagcgtctaagctgaacgaggaggtgatcaataggatatccggccaaaagagtaaagagtacaagttgactaagactaataacgggtggattcttggactaggggcaaacgatggctctgatgcgcaaaaagcaatcgtaatagacgataaagatgcaggcgctttggtaaagcagttagatagtaatgctgaggacggggacgtgctccgatgggatgatttggaagataattccttaaaaatagtgcgacatgagtcttctaacgcgacgacagctccacagaaaaggagtaaccggtcagaagatgagggatgtgactctgatgaatgtgagtgggaagaagttgaactcaagcccaagaacgtcaagtttgtggaagatttttctttgaaagctgcaaggttgccttacatgggccaatccctaaacaacgctggcagtaaatcgtttttggacaaaagacatgatcaggcatcgccctccaagactactccaacaatgagaattagcagaatcagcgtggaagacgacgatgaggattacctgaaacaaattgaggaaattgaaatgatggaggcagtgcaactttctaagatggaaaagaaacctgaagcggacgacaaatcaaaaatcgctaagccggtaacgtcaaaaggtacagaggctcgtccaccaatagtacagtatggattacttggcgcacaaccggatagtaagcaaccgtatcatgtcacaaatttgaatagcaaatcagagtcggtcatcaaaaggaccagcaagacagttctttctgagtttaggccaccgtctcagcaggaggataaaggggctattttaacagagggggagcaaaacctgaattttatttctcacaagataccacagtttgattttaacaatgaaaattccctgctttttcaaaagaataccgagagtaatgtgtcccaagaagccacgaaggaaaagtctccaattcctgaaatgccgagctggttttcttcaactgcttcccagcagttgtataatccctataacacaacaaatttcgtggaagataaaaacgtaagaaatgaacaagaaagtggagcagaaactaccaataaagggagtagctatgaactcttgacaggcttaaatgctacggaaatattagaaagagaaagcgagaaagagagctccaatgatgaaaacaaggacgatgacttagaagttttatcagaagaactatttgaggacgttcccactaaatctcagatttcaaaagaagcagaggataacgatagtagaaaagtcgaatctataaataaggagcatagaaagcctcttatattcgactatgacttctccgaagatgaagaagataacatagtagaaaatatgataaaggaacaagaagagtttgatacatttaaaaacacgactttgtccacttctgctgaaagaaacgttgccgagaacgcttttgtggaggatgaattattcgaacaacagatgaaggataaaagagattcggatgaggtaactatggatatgatcaaagaagtgcaagaattactatcgaggtttggaatcccctatatcactgcgcctatggaagctgaagcacagtgtgcggaattgttacaactaaaccttgtcgatggtataattaccgatgacagtgatgttttcctatttggaggtacaaagatctacaaaaatatgttccacgaaaagaactatgttgaattttatgatgcggaatctattttaaaattattgggcttggatagaaagaatatgattgagttggcacagcttttagggagcgattacacgaatggattgaagggtatgggtcccgtttcaagcattgaagtgattgcagaatttggaaacctaaaaaattttaaagactggtataataatgggcagtttgataaacgtaagcaagaaacggaaaataaatttgaaaaagacctgagaaaaaaactggtaaataacgaaattatcttagatgatgattttcctagcgtcatggtttatgatgcgtatatgagaccagaagtcgatcacgataccacgccgtttgtttggggggtaccagatctcgatatgcttcgttcattcatgaagactcaactaggttggccacacgaaaagtctgatgaaattctcattcccttaattagagatgttaataaacgcaaaaagaaggggaagcaaaaaaggattaatgaattttttccaagggagtacatatctggtgataagaagctcaatacaagtaagagaatttcaaccgcaacaggtaaactaaagaaaagaaagatgtaa

SEQ ID NO: 453 - DNA, 2859 bp, Saccharomyces cerevisiae
atgacagacgaaactgctcacccgacacaatctgcttcaaagcaggaatctgctgctctgaaacagacaggcgatgaccagcaggaatctcagcaacaacgtggctacaccaactacaacaatggtagcaactatacccaaaagaagccttacaacagcaacagacctcatcagcaaagaggtggtaaatttggaccaaacagatataacaaccgtggcaactataatggtggcggtagtttcagaggtggacacatgggagccaacagctcaaacgtgccatggactggttactataataactaccccgtttactaccagccccagcaaatggcggccgctggtagtgcccctgctaatccaattcctgtcgaagagaagtcacctgttccaactaagatagaaatcactaccaagtctggtgaacacttagatttgaaagaacagcataaagccaagctacagtctcaggaaagatctactgtgtctccgcaaccagagtcaaagttaaaagaaacttctgattctacttctacttctactccaactcctaccccttccactaatgactctaaggccagttctgaagaaaatatatctgaagctgaaaagacaagaagaaatttcatcgagcaagttaaacttcgtaaagctgctttagaaaagaagagaaaggagcaacttgaaggttctagtggcaacaataatattccaatgaagactaccccagaaaatgtggaagagaagggatcggacaaacctgaggtaaccgaaaaaaccaagcctgctgaagaaaaatctgctgagccagaagttaagcaagaaactccagctgaagaaggtgaacaaggagaaaagggccaaataaaggaagaatccactccaaaggtgttaacctttgctgaacgtttgaagttgaagaaacaacaaaaagaacgagaagaaaaaacggaggggaaggaaaacaaggaagtgccagtacaggaagagactaagagcgccatcgagtctgctcctgtgcctcccagtgaacaggttaaagaagaaactgaggtcgccgaaaccgaacagtcaaacattgatgaatctgcaacaactccggctatccctactaaatctgatgaagctgaagctgaagttgaggctgaagcaggtgatgctggaacaaagattggacttgaagctgaaatcgaaactacaactgatgaaactgatgatggtacaaacaccgtttctcacatattgaatgtattgaaagatgctacaccaattgaagatgtcttttcttttaactatccagaaggtattgaaggtcctgatatcaaatacaagaaagaacacgtcaaatatacatatggcccaactttcttgcttcaatttaaggacaaactaaacgtcaaagcggacgccgaatgggtccaaagcactgcttctaaaattgtcattccaccaggaatgggcagaggaaatagatctagagattctggcagattcggcaataattctagtcgtggccatgactttagaaatacctcagtgagaaatatggatgacagagctaattcaagaacttcatcaaagagaagatcaaagagaatgaatgacgacaggagatctaatagatcttatacatcaagaagagaccgcgagagaggctcctacagaaatgaagagaaaagagaggacgataaaccaaaggaagaagttgctccacttgttccaagtgctaataggtgggtgccaaaattcaagtctaaaaagactgaaaagaagctagcccctgacggaaagaccgaactattggacaaggatgaagttgaaagaaagatgaagtcactactgaataaacttactttggaaatgttcgatgctatttcatctgaaattttggctattgcaaacatatcagtatgggaaacaaatggtgaaacgttaaaggctgtgatagaacagattttcttaaaggcctgtgacgaaccccattggtcttctatgtacgcgcaattatgtggtaaagtagttaaagaattaaacccagatataacagatgaaactaatgaaggtaagacaggtccaaaattggttttgcattacttggttgctagatgtcatgccgaatttgacaagggttggaccgataaattacccacaaacgaagatggtactccattagaacctgagatgatgtcagaagagtactatgcagctgcttctgctaagagaagaggtttaggtttggttcgtttcatcggtttcctataccgtctgaatctgttgactggaaagatgatgttcgaatgtttccgtagactaatgaaggatttgacggattctccatctgaagaaactctagagtccgttgttgaattgttaaatactgttggtgaacaatttgagaccgatagtttcagaacgggtcaagcaacattggagggttcgcaattgctcgatagtttgttcggtattttagacaatattattcaaactgctaagatttctagtagaatcaagttcaagttgatcgacattaaagaattaaggcacgacaagaactggaacagtgataagaaggacaacggtcctaagaccattcaacagattcatgaggaagaggagagacaacgtcaattgaagaataattcaagatctaattcaagacgtacgaacaactccagtaatagacactctttcagaagggacgctcctcctgcatcaaaagatagctttatcacaaccagaacatattctcaaagaaatagccaaagggctcctcctccaaaggaagaaccagctgcaccaacttctaccgcaacaaatatgttcagtgcattaatgggagaaagtgatgacgaagagtaa

SEQ ID NO: 454 - DNA, 2679 bp, Saccharomyces cerevisiae
atggtttctttatttgataagcttaatgcaaaaaaagacggtagagatggatctgtgtcgaaggagttgctatcacattctgtagcccatactaagaacaggttacccaaatcaggaaggcgcacgtcggaacggtccttagccgctagtgtaaaggacggaagttgctcaaatagcaaaagcaataagcggaactcttcggcatccgtgtcaggggaagaagataaatcctgtctaatttcacttaattgcctatgttgtggtgtcccactacggtttccagcctccataacgaaatttcgatgcagcgcatgccaagtaacagttattgtaaaggagccggaaattaacagtaatttggaatctagtacgcatatttcgtgcacattagagggtttgcagatggtagtaaggcggtgccatgatgatttgcagcggcttaagaagactgggattctggataaagaaagaaaggggttgattttccaaccggtaataacgtatttactggacagatttcatgatgttagcattttaaacaggtcgttcttggtacatgatggtggaaagaatataaagatgctgaattatgaagttttacaaagattttacagtatattatcaaatcttcctacaaggaaaccgtattatagtatgctgtgttgctgtaacgatctactgaagagaataacaatcaataaaggggaaaatttgcaaatattacagtatcgttggttgctgattatattaaatatacctacaatacgaacctgccttattagagatcggaagagcaaaaatgtgtttgagacccaacaaataagggcggtgtcttatgagttggccaaacgatgtattggctacttgtctaacctatcaacaaaaacatctcaacaattgattcaatcattacggcgaacgcctacggataatttttcataccaggtagagattttaaatttatacatcaatttccaattttccagattactgtcgaacgaattatcaaatagaaccgcaaaaaataacgtgaagcctgaagatgagatgcgatctcgtcttcgtcggcatcacactactggccatgaattcctgagtactagaccaataagtgcacaatcaaatgataaacagggaagtggtttcacgcatcccgtcaataataagatgaaatttaaattttttcaatatgaggaagactggcatattcactctgcagcaaaattgacgttcatctattatgtagccaatactagaagaaatggccgtggagcgttgtcaattcaaagcttttacaatataacgctagacttcatagattataaacaagatttcgatcattggagaggagtagctcaaaagacaaaaatgaatcaactgattgaagagtggggaaattcgacgacaaaaaaatgtttttcattctgtaagtatccatttatattgtcactcggcatcaaaatctctattatggagtatgaaattcgcagaatcatggaacatgaagctgaacaggcttttttaatttcactggataaaggcaaatccgtagacgtttatttcaaaatcaaagtacggcgtgacgttatttctcatgattcattgagatgtatcaaggaacatcaaggcgatttattaaaatcgctgagaatagagtttgttaatgaacctggaattgatgcgggagggttgagaaaagaatggtttttcttattaacaaaatcgctgtttaatccgatgaatggcttatttatttacataaaagaaagctcacgttcatggtttgccattgaccctccaaattttgacaaatcaaaaggaaaaaactcacaactggaattatattacttgtttggagttgtcatggggttggcgattttcaacagtaccatattagatttacaatttccaaaggcgctttataaaaaactatgctcagagcctctgagttttgaagattactcggaattgtttccggagacaagtaggaacttaataaaaatgctcaattacacagaggataatttcgaagacgtcttttctttaacatttgagactacgtatcgaaataacaactggattttaaatgacagtaaatcgagcaaagagtatgtaacggtagaattatgtgaaaatggcagaaatgtgccaataacccaaagtaacaagcatgagtttgtcatgaaatgggtagaattttatctggaaaagtccattgagccacaatacaataaatttgtttcaggttttaaaagggtcttcgcagaatgcaattctataaaattatttaattctgaagagctggagagattagtgtgtggtgatgaggaacaaactaaatttgatttcaaatcgttaagatccgtgacaaagtatgtaggtggcttctccgatgattccagagcggtttgctggttttgggaaattattgaaagttgggactatccattgcagaagaaattattacaattcgtaacggcatctgatcgtatacctgcaacgggtatctctactatcccattcaaaattagcttgctagggtcgcatgatagtgatgatttgccattggctcatacatgttttaatgaaatatgtttatggaattattcctcgaaaaaaaaactagaactgaaattactttgggcaattaatgaatctgaaggttacgggttccgctaa

SEQ ID NO: 455 - DNA, 1719 bp, Saccharomyces cerevisiae
atgtgtggtatctttgcagccttcaagcatgaagatattcacaacttcaaaccaaaagctctacaactatctaaaaaaatcagacaccgtggcccagattggtcaggaaatgccgttatgaattccaccattttcgttcacgagaggttggctattgttggtttagactccggtgcccagccaatcacttcagctgatggcgaatatatgcttggcgttaatggtgagatctacaaccacatccaactaagggagatgtgctctgattacaagtttcaaactttcagtgactgtgaacccatcataccgttatatttggaacatgatatcgatgctccaaaatatctggacggtatgttcgcattttgtctgtatgattccaagaaagaccgtattgtcgctgcaagagaccctatcggtgttgtcactttatacatggggcgttcttctcagtctccagagaccgtttattttgcctccgaattaaaatgtctaactgacgtttgtgacagtatcatttcgttccctcctggtcatgtctacgattctgaaacggacaagattactcgttactttaccccagactggttggatgaaaagcgtatcccatccaccccagttgactaccatgctatcagacacagtttagaaaaggccgttagaaagaggctaatggctgaagttccatacggtgttcttctatccggtgggctggactcttctttgattgctgcgattgctgctcgtgaaacggaaaaagctaatgctgatgctaacgaagacaacaatgttgacgagaagcaacttgcaggtatcgatgaccaaggccatctacacacatccggttggtctcgtttgcattcgtttgcgattggtctaccaaatgcacctgatttacaagcggctagaaaagtcgccaaattcattggttctatccaccatgaacacacttttacattacaagaaggtttggatgctttggacgacgtgatctaccatttggaaacttacgacgttaccactatcagagcttctacaccaatgttcttactatctagaaagattaaggcccaaggtgtcaaaatggttctttctggtgaaggctcggacgaaatattcggtggctatctatatttcgcacaagcaccttctgctgcagaatttcacaccgaatctgtgcaacgtgtcaagaacttgcatttggcagattgtttgagagctaataagtccacgatggcttggggtctagaagctcgtgttcccttcttagacaaagactttttgcagctatgtatgaacattgatccaaatgaaaagatgatcaagccaaaggaaggacgtatcgaaaaatacattttaagaaaggcattcgacactacagatgaaccagatgttaagccatacctacctgaagaaatcttatggagacaaaaggaacaattttccgatggtgttggctactcatggattgacggcctaagagacactgctgaaagggccatttctgacgccatgtttgccaatccaaaggctgattggggcgacgatattccaaccaccaaagaagcttactggtacaggctgaagtttgatgcttggtttcctcaaaagactgcggcagacactgtcatgagatggattccaaaggccgattggggttgtgccgaagatccttcaggtagatacgccaaaatacacgaaaagcacgtcagtgcttaa

SEQ ID NO: 456 - DNA, 1644 bp, Saccharomyces cerevisiae
atggtccgattaaatcatgcagcatcatattttatgcctattttctgctccacaaggcctcacatagtgatactttctgcgctgtttagtatttcactgttttcactattctatgcgtcgtccgaattactgctacaccagtatgatgatccattgatgttcaaaccaaattcgcaggactatttcaggacctttcttttggggcttttttcaccatttctttattatttcctgaagacctttctattcaatataaatcaaaggtttttaatattgaacctgatagtggattttcctatcaacgacgtctttatgcttttgatactgattggtttagcgtaccctcaggtgcaagatcacgaaggcggtacgatcaagcataaggaatgttcttggcacatcattccaagacaagcctatatctttggtatatcatgggccctgggtgaattcaccatatgcataatagggaatttgtttaactaccaagaaatcgccgatccaaacattaatagtggcttcacacaccaggaaagcgccaacacttactgtaacaataatgatatgagccataacgatgactgcggttgtagtacagaatatcgccccaacgtcgtagacagaagtgatattacgttgtccaaatgtattgaagtaagaaatgactcatcttccatatcgaataacgtatactcgtctgagtaccatccaatcaaacctctacgttcatcgtcatcaacttatggcagcatacgacagcaacctcatgaaaataagaagcagctgcatgtaccagataattcgcaggacgatacaattatcatgatgaaccccatcgacaattcattaaagttgacaactctagatacgggtgatttgagtttccccatagacgaagaacagcccattttgaagaaatcttttggttatacatgggcagttcctaatgaaaatacacaaaatactactaaaagcttcacaccgataaagagatttattgcatttagcacggcataccagttggtcaccggtttattgttaatgatattggtagttggtagtaatatcatgttgacaattggggaatcattgattctgtcgatgtatttcgtctatgttcgcggccatgaaggattatttactcccgtggtgaactacttcggctcaagaaccatttcaaatttcatcttatgcgtaataattcctttcatatctctaaacttcctcatcaacacttcgatatatttaagaagagagctagacgattggtttaataattcacagggggagtttgaggacgacgacgaaaatactatcagtaagagagtagctacaaatcaagagtaccaacatccactgagtgctaattacatttcgatggatagtcctgatgtaataaatagcagcccgggtcacttcgggatgaattcaggccagttgttaggtaatacgacgttatattatggtagtttaaatggggatgatgatgatatgaccaacgactccgctttactaagattctgcaagaagctagtcaaaaattggagggctttggcaagaaatgattcttttgtacttggagtaatggtttcttggagtcttcttgtttttgtaacgggaatactttcaacagtttatatatag

SEQ ID NO: 457 - DNA, 1920 bp, Saccharomyces cerevisiae
atgagcgaatcagtgaaagaaaacgttactccgacacgtaacttccgtcgtactcaagggccccaaaataatacaaaacctcacaacgacaggaagaatttcagaagaaagcaaaagaaaaataacctttctgctgaacccaacctcaccacttcaagcgcagatgatactgatgaagaaaatgaattatgtgtaatttgtgcgcgcaagttaacatacgtatctctaacaccatgccatcataagacatgccatatctgtggtttcagacaacgagctttgtacaacaagaaaagctgtttgatttgcagaacggagaatgaagaagtcatgtttaccgatcgcatagatggtgatatttcagataaatataacttttgcgaaaaaaatgaaaaatatggaataaatttcactagcgaagaggttgctaccgaaacactaaatcttttaaaatttttttgtcccctatcgaaggatgaacaagtttgtgactttggtagtttcaagaaatataatgaacacttgaaatctgaacataacagaatgatctgtttaatatgtgcaacccataagcatgcattcccttgtgagcttgaaatattcacccaaaatcaattacgcaaccatcaaactaagggtaattcagaaggattcaaaggccaccctatgtgtgccttctgttccggaaaacgattttattcagacgacgaattgtacattcacatgagaaatcagcatgaaaagtgccatatttgtgataagatgaaccccgcttctcctcaatactttaaggattataatcagctttttgaccactttaaacattcgcattacgtttgcaccgtccaaacttgcttagataacaagtttgtcgtatttaaagacgagttggagttacaagcccacattttgcaggagcatggtaatatcctgaagggaaagccaaagtttttccagtcagaactttctacttttatctcggctccatctagagtgatcagggaaagagatgattacgaccttccatctatatcttccctaccgggttcatcatccggctctagaactgatgtgagatctgctagttctcccgaggaaagtagactaagattggcagaaagagcaaaatactatctggaaaattccaaagaagacttcaataagttttcttcttataacgaagattattctaaaggtcgcttaagtgctgaaaaattattggaatcatataaattgttattcacaaaaccaaatgcggatgtatatttattgattcataacttagctgaaacctttcccaaaaactcctccaaatacaataatctgaacgccatatatgaacaaagagagcaaacccttgcacgacaaacttcactaccttctttatctagtgattcttccctttcaatgtcaataggcaggggccattggggtggaacaaacgatgggggcagcgctggtgcagcattaggcgttaggaatatcaaaaatcttccaaccctgaaaagtccttcagcgtcgtatgatccctttgcaaccaccgtaaaaaaaaacactctgagacccgtgcaaaacattaaaagaactacacctcaatcagttagttatcgaacttccactaatacagtcgccttctctccaacctatttggaaagtaaaaagggttcctcttctacttctctaaataatagcaaagataaattgaaaagtctcaacctacctcaactacctccaccaaagccaaaggtgcaaattccaggtctgaacagaccccaaattgctgatcctaagcagtggggtaaaaagtcaagcacacaagatactaacgtgcacgataatttgagggaattgaacacaactagtggaggaaataaaaagaaaggcaaacaaaagcagctgttattccacattggtgtatag

SEQ ID NO: 458 - DNA, 1212 bp, Saccharomyces cerevisiae
atggccgccattagagactacaagaccgcactagatcttaccaagagcctaccaagaccggatggtttgtcagtgcaggaactgatggactccaagatcagaggtgggttggcttataacgattttttaatcttaccaggtttagtcgattttgcgtcctctgaagttagcctacagaccaagctaaccaggaatattactttaaacattccattagtatcctctccaatggacactgtgacggaatctgaaatggccacttttatggctctgttggatggtatcggtttcattcaccataactgtactccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacggcagatggaaagagaaatgcaaagttggtgggtgccatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctactggttgttgatgaaaagggtaacttagtttctatgctttcccgaactgatttaatgaaaaatcagaagtacccattagcgtccaaatctgccaacaccaagcaactgttatggggtgcttctattgggactatggacgctgataaagaaagactaagattattggtaaaagctggcttggatgtcgtcatattggattcctctcaaggtaactctattttccaattgaacatgatcaaatggattaaagaaactttcccagatttggaaatcattgctggtaacgttgtcaccaaggaacaagctgccaatttgattgctgccggtgcggacggtttgagaattggtatgggaactggctctatttgtattacccaaaaagttatggcttgtggtaggccacaaggtacagccgtctacaacgtgtgtgaatttgctaaccaattcggtgttccatgtatggctgatggtggtgttcaaaaacattggtcatattattaccaaagctttggctcttggttcttctactgttatgatgggtggtatgttggccggtactaccgaatcaccaggtga

SEQ ID NO: 459 - DNA, 1248 bp, Saccharomyces cerevisiae
atgtctcaaggtactttatatgctaacttcagaattagaacttgggtcccaagaggtcttgtcaaggctttgaagctggacgttaaggttgttacgccagatgccgccgctgaacagttcgcaagggactttcccttgaagaaggttccggctttcgtgggtccaaagggttacaagctaaccgaggcaatggcgattaactattatttagtaaagctttcacaggacgacaagatgaagactcaacttttaggtgccgacgatgacttaaatgcccaagcgcaaatcatcagatggcaatctttggccaacagtgatctgtgcatccagattgccaacaccatcgttcccttgaagggcggcgccccctacaacaagaagagcgttgattctgcgatggacgctgttgacaagatcgtcgacatcttcgagaacagattgaaaaactacacctatttggctacggaaaacatctccttggccgacttggtggctgcctcgattttcaccagatactttgaaagcctgttcggtactgaatggagagctcaacatccagccatcgtgagatggttcaacaccgttagagcctcacccttcttgaaggatgaatacaaggatttcaagttcgctgacaagccattgagtccccctcaaaagaagaaggaaaagaaggccccagccgccgctcccgccgcttcgaagaagaaggaggaagccaagccagctgctaccgaaactgaaacttcttccaagaaaccaaagcacccattagaattattgggcaagtcaactttcgttttggatgactggaagagaaagtactccaatgaagacaccagaccagttgctttaccttggttttgggagcactacaacccagaagagtattccctgtggaaagtcacctacaagtacaacgatgaattgactttgactttcatgtccaacaacttggtcggtggtttcttcaacagattgtccgcctctaccaagtacatgttcggttgtctggtagtctacggtgaaaacaacaacaacggtattgttggtgcagttatggttaggggccaagattacgttccagctttcgatgtcgcaccagattgggaatcttacgactatgcaaagttggatccaactaacgacgacgacaaagaattcatcaataacatgtgggcctgggataagccagtttccgtcaatggcgaaccaaaggaaattgttgacggtaaggtcttaaaataa

SEQ ID NO: 460 - DNA, 1935 bp, Saccharomyces cerevisiae
atgttaccatcatggaaagcctttaaagcacataatatacttcgtattctgacccgtttccagtcaaccaaaattccagatgcagttatcggtattgatttaggtactaccaattctgcggtagctattatggaaggtaaagttccgagaattatcgaaaatgcagaaggctcaagaactactccgtctgtagtggctttcactaaagacggagaacgtttagttggtgagccagccaaacgacaatccgtcataaactcagaaaacactttgtttgctactaagcgtttaatcggccgccgtttcgaggacgctgaagtccaaagagatattaatcaggttcctttcaaaatcgtcaagcattctaatggagatgcctgggtagaggctagaaacagaacgtactcccccgcccaaataggaggttttatcttaaataaaatgaaggaaacagcggaggcttacttagcgaagagcgtcaaaaatgctgttgtcaccgttcctgcttacttcaatgatgcccaaagacaagctactaaagacgcaggacaaattattgggcttaatgtattacgtgttgtcaacgaaccaacagctgctgccctagcttacggtctagataaatcagagccaaaagtcattgctgttttcgacttgggcggtggtactttcgatatttcaatcctggacatcgataacggtatctttgaggttaaatctaccaatggtgacacccatttgggtggcgaagattttgacatttatttgttgcaagaaattatttctcatttcaagaaagaaaccggtatcgatttgagtaatgaccgtatggctgtccaaagaataagagaagccgctgaaaaggctaaaatcgaactgtcttctacactctctacagaaataaacttgcctttcataactgctgatgctgcaggcccaaagcatattcgtatgcccttttctagggttcagcttgagaatataaccgccccattgattgatagaacggttgatcctgtcaaaaaagcactgaaagacgcaagaattaccgcctcagatatatcggatgttttattagttggtggtatgtcaaggatgcccaaggttgcagatactgtaaagaaattattcggtaaggatgcatcaaaagctgttaaccctgatgaagcagtcgctttaggggccgctatacaggctgcggtcttgtctggtgaagttaccgatgttttgttgctagatgtcactcccctatcattgggtattgaaactttaggaggagtttttacaaaattaatcccaagaaattctacaattcccaataagaaatctcaaattttttcaactgcggcatcaggtcaaacatcggtggaagttaaagttttccaaggtgagagggagttagtcaaggataacaaattaataggtaattttactcttgcgggcattcctccagctccaaaaggtaccccacaaattgaagtcacttttgatatcgatgcgaacggcatcatcaacgtttcagcaaaagatctcgccagccacaaagactcttccatcactgttgccggagcgtctgggctatctgatacggagattgatcgaatggttaatgaagcggaaagatataaaaatcaggatagagccagaaggaatgccatcgaaaccgctaacaaagctgaccagctagctaatgacacagaaaattccattaaggaattcgaaggtaagctagataaaactgattctcaaagactaaaagatcaaatttcatccttaagggaattggtttctcggagtcaagctggagatgaggttaatgatgacgatgttggaacaaaaattgacaatttgcgaacttcatcgatgaaactttttgaacagttatacaagaacagtgacaatcctgaaactaagaacgggagagaaaataaataa

SEQ ID NO: 461 - DNA, 1728 bp, Saccharomyces cerevisiae
atgacggaaattgaatttgggcaaccccttcccagcaatctagactatgctgtttcttttggcattcctacatgggattcggcaataggctatgcggaaaaggtgccagaggtaataggcaaaatggctacaggatatccgaggtactttcctcaaccccccgtccagaggctttgtgcttactttgttaagaaatttgggcgaggttcagaaaactgtcgtccttttccatccgttaacctgggtttaaagtgtttcgagtacgtaaaatctgtctcaggacctgaaagtaaagctcaccttgaagtggaaacagttacgattaaaaaccgtggggcaaaaacgtcgaaagaaccggcggaattggtgctaaccattgctgctgtccttgcatcggaggaagagttcgagactgtgaaagagtattggaaattaagaggtgaatgtgtatctagtcgattggcgttgtctgtcaaccaacttcttgactgcgctaatcatggctcagagcaggtattgcgtgagctagaggctggtgtttttgcagcaaagaagggggaggagaaagcaaagaacctgataaagggaaggatagttgagaatcgcttcaggccctttggtttggagaagaaaaccccgaattgggagggactcaacctcaacccaaatgaagacgtttatcttgtatcaagtggcatgtctgcaatatctacggctcgtaatttactcaccttttgggaggagaagaagaattcaggagattcattaaacaagaccacctctgaccaaaagaaaaagccattattatgtgacactgttggcatcttcggcttccctttcaaagatacgcaggtcattatgactaaatttggaaaatgtaaattttttggatttggaaattctagagacgttgtcgaattacaaaagtttttagaaacaagcaaacaacgcattcttgccgttttcgtcgagacaccttcaaatcctctgctgaatatgccggatttgaaaaaattgaggagtttggccgaccagtatggcttttttattgtaattgatgatactattgggggccttaacgttgacatcttgccctatgctgatatagtcagcacgtccctgactaagcttttcaatggtgctagtaatgtaatgggcggctctgtcgttttaaatccgaaatcatctctgtatccatatgctcgtgagtacttcaggagcgctaatttcgaggatttgttatggtgtgaagatgcgatagttttagaacgtaattccagggattttgaagatagaactttacgtgctaatgcaaacacaggaatattgttgaatgatttgcttttacccgaggaggggaaaatatgcaaaaagatttattatccaactgttacttctaaggagacctttgagaactacgaaagtgtacgtaatgaacgtggtggctatggatgcttgttctctgtagcctttttcaatgagggcgatgcaaaagcattctatgactctttaaaggtattcaagggaccttctaatggtactaactttaccttagcatgtccatatgtccatctggcgcaccactcagaattagaagaagtttccaagtttggggccgaccccaacattattagagtaagcgtaggtttagaagatatccagtggttattgaaagttttttcaagtgctttagatgttgtgaaaagcagaggctccaaacactcatga

SEQ ID NO: 462 - DNA, 1536 bp, Saccharomyces cerevisiae
atgcctgctcctcacggtggtattctacaagacttgattgctagagatgcgttaaagaagaatgaattgttatctgaagcgcaatcttcggacattttagtatggaacttgactcctagacaactatgtgatattgaattgattctaaatggtgggttttctcctctgactgggtttttgaacgaaaacgattactcctctgttgttacagattcgagattagcagacggcacattgtggaccatccctattacattagatgttgatgaagcatttgctaaccaaattaaaccagacacaagaattgcccttttccaagatgatgaaattcctattgctatacttactgtccaggatgtttacaagccaaacaaaactatcgaagccgaaaaagtcttcagaggtgacccagaacatccagccattagctatttatttaacgttgccggtgattattacgtcggcggttctttagaagcgattcaattacctcaacattatgactatccaggtttgcgtaagacacctgcccaactaagacttgaattccaatcaagacaatgggaccgtgtcgtagctttccaaactcgtaatccaatgcatagagcccacagggagttgactgtgagagccgccagagaagctaatgctaaggtgctgatccatccagttgttggactaaccaaaccaggtgatatagaccatcacactcgtgttcgtgtctaccaggaaattattaagcgttatcctaatggtattgctttcttatccctgttgccattagcaatgagaatgagtggtgatagagaagccgtatggcatgctattattagaaagaattatggtgcctcccacttcattgttggtagagaccatgcgggcccaggtaagaactccaagggtgttgatttctacggtccatacgatgctcaagaattggtcgaatcctacaagcatgaactggacattgaagttgttccattcagaatggtcacttatttgccagacgaagaccgttatgctccaattgatcaaattgacaccacaaagacgagaaccttgaacatttcaggtacagagttgagacgccgtttaagagttggtggtgagattcctgaatggttctcatatcctgaagtggttaaaatcctaagagaatccaacccaccaagaccaaaacaaggtttttcaattgttttaggtaattcattaaccgtttctcgtgagcaattatccattgctttgttgtcaacattcttgcaattcggtggtggcaggtattacaagatctttgaacacaataataagacagagttactatctttgattcaagatttcattggttctggtagtggactaattattccaaatcaatgggaagatgacaaggactctgttgttggcaagcaaaacgtttacttattagatacctcaagctcagccgatattcagctagagtcagcggatgaacctatttcacatattgtacaaaaagttgtcctattcttggaagacaatggcttttttgtattttaa

SEQ ID NO: 463 - DNA, 3342 bp, Saccharomyces cerevisiae
atggatcaacaatttctaagtcaacttgagcaaactttgcacgctatcacttctggtgtaggcttgaaggaggctacaaaaactttgcaaactcaattttatacccagcctacaactttgccagctttgattcatattttgcagaacggctccgatgattcgttgaaacaactagctggtgttgaagctagaaagttggtttccaagcactggaacgccattgatgaatccactagagcctccatcaaaacatctcttttacaaacagcatttagtgagccaaaagaaaatgttcgtcattccaacgctcgagtaattgcttctattggtactgaagagctagatggtaacaaatggccagatttagtccctaacctaatccaaactgcttctggtgaagacgttcaaacaagacaaactgccatttttattttgttttctctgttggaagatttcacctcttctctatctggccacatcgatgactttttggctttgttctctcagacaattaatgatccatcttctttggagatcagatcattatctgcccaggctttgaaccacgtttctgctttgattgaagaacaagaaaccatcaaccctgttcaagctcaaaaattcgccgcctcaattccatctgtggttaacgttttagacgcagttatcaaggccgacgacaccatgaacgctaaattaatctttaactgtttaaacgatttcctgctattggactcccaattaacaggaaactttattgtggatttgattaagctgtctttacaaattgctgttaacagtgagattgacgaagatgttcgagtttttgctcttcaattcatcatatcttcattgtcctacagaaaatcgaaggtttctcaaagcaaattgggcccagaaattactgttgcagctttgaaggtggcttgtgaagagatcgatgttgacgatgaattaaacaacgaagacgaaacaggcgaaaatgaggaaaatacaccctcttcttctgctattagactgttagctttcgcttcctctgaactgccaccatcccaggttgcttccgttattgttgaacacattccagctatgttgcaatccgcaaacgtttttgagagaagagctattcttttagctatttccgttgctgttactggttctccagactacattttgtctcaattcgacaaaattatccctgccaccataaacggtttgaaggatactgaaccgattgttaaattagctgctctgaagtgtattcaccaattaaccactgacttacaagacgaagttgccaaatttcatgaagaatacttgccattgatcatcgatatcattgattctgcgaaaaacattgtcatttacaactatgcaactgttgctttagatggtctgcttgagttcattgcttatgatgctatcgctaagtacttggatccattaatgaacaaactattctatatgttggaaagtaatgaatcatccaagttgagatgtgctgttgtttctgcaattggttccgctgcttttgcagcaggttccgcgttcattccatatttcaagactagtgttcactatttggaaaaattcatccaaaactgttctcaaattgaaggtatgagcgaagatgatatagaactaagggccaacacttttgaaaatatttctactatggccagagccgtcagatcagacgcatttgccgaatttgccgaacctttggttaactccgcctatgaggccatcaaaactgattctgctagattaagagaatctggttatgcattcattgcaaacttggctaaagtttacggcgaaaattttgctcctttcttgaaaactatcctaccagaaatcttcaagacactagaattagatgaataccaattcaacttcgatggtgatgcagaggatttagccgcatttgctgattctgccaatgaagaagaactacagaacaaattcaccgttaacactggtatttcctatgaaaaggaagttgcttctgcagctctatccgaattagcattgggtacgaaggagcatttcttgccatacgtcgaacaatccttaaaggttttgaatgaacaagtcgatgagtcgtacggtttaagagaaaccgctctaaacaccatctggaatgttgttaagtctgtcctgttggcttccaaagtagaaccagaaagctatcctaagggtatcccagcctcttcctacgttaatgctgatgttttggcggttattcaagctgccagggaaacttccatgggtaacttaagcgatgaattcgaaacctcaatggtcattaccgttatggaagattttgccaatatgattaagcaatttggcgcaatcatcatcatggacaacggcgactcttctatgctagaagctttgtgcatgcaagttcttagtgtcttgaagggtacccatacttgtcaaaccattgatatcgaggaggacgttccaagagatgaagaattagacgcttctgaaaccgaagcaactttacaagatgttgcattggaagttcttgtcagtttatctcaagctttagctggtgattttgccaaagtctttgacaacttcagaccggttgttttcggattattccaatctaaatccaagaataagagatcatccgccgtcggtgccgcctctgaattagctctaggtatgaaagaacaaaatcctttcgttcatgaaatgctagaagccttagtcattagattaacaagcgataaatctttagaagttagaggtaacgcggcttatggtgttggtttgttgtgtgaatatgcttctatggacatctcagccgtttatgaacctgttttgaaggcgctttatgagttactaagtgctgctgaccaaaaggccttagcagccgaagatgacgaagccaccagagagattattgatagagcatacgctaatgctagtggatgtgtggccagaatggctttgaagaacagtgctctagttccattggaacaaactgttccagcattattggcacatttaccactaaacaccggttttgaagaatacaatccaattttcgaattgatcatgaaactataccaggaaaatagtcccgttatcacaaacgaaaccccaaggatcatcgagattttcagtgctgtgtttaccaaagaaaatgatagaattaagttagaaaaggagtctactctaggtagggaagagaatatggaaagattaaagcaattccaaaccgaagagatgaagcataaggttattgaattattgaagtatctaaacactacttacaacggaattgttgctcaaaatccggttttagctgccgtcattgcttga

SEQ ID NO: 464 - DNA, 1113 bp, Saccharomyces cerevisiae
atgctcttaggttactgtggcagcggatactatggaatgcaatacaacccaccacacaagacgattgaaggtgagattctcaccaagctcttcgacgtaggagccatttccgaagaaaattcattggcaccgaagaaaaattcctttatggcagcggcaagaacagacaagggtgtacacgctatgttgaatctactgtcgctaaagatcacattgcgagaggacacagtagcgaagttaaacgccgcactaccgcccgaaatacgcgtgtggggtatccagcctgtcaataaaaagtttaatgctagatccgcgtgcgattctcgatggtaccaataccttatcccagaatttatactcattggtccaccccggagttctcttttgcatcgaaacgtggggggatcgtaccgcgaagacggctcgcaagaggtgtgggatacgttcctggaacagacgcgtgggagatttagcggggatgagctgtgccgtttgcaggacactgcacagaaactaagcgagagcgatcctttggtacaagactacgtggggctattgagcggtacccttagcggctactgcttgtcgccctcgaagctggacgcgtttgaggcagccatgcaggagtacgtgggaacgcataattttcacaactttaccacaggaaagctttggggggatcctagtgctcagcgccatatcaaaaaggttgtagtgtcgcaggcctcaccgggatggatatgtgtgcggatccacgggcagtcgtttatgttgcatcagattcgacgaatggtagcgcttgccgtacttgcagcccgttgccaattgccgcctaatattgtacgtaactattttaacgccgggcctaggaaatacattccgagggcgcccgcacaaggcctattattagagggacctgtgtttgacgggtataacactaagttgcgcaatttgctgtattgcgaaatccgcccggacgatatcactcttgagcgcatgtgccgtttccgagaacgccagatctgtactgcgatcgcacacgaggagacacagcgtcacgtgttttgccattttgtacgacaaatgaaccgcctggccacgcctctaatctag

SEQ ID NO: 465 - DNA, 1839 bp, Saccharomyces cerevisiae
atggtggtttcttataacaataataataacaataacaataacaataacaataataatatcagtaataataataacaataataacatgttccctccttttccttcttccgatgactttgcaatgtatcaacagtccagttcttccggcccttaccaagaaacttatgcgagtggccctcaaaactttggcgatgctgtgtatcctatgaatggtaattttactcttttaccatccgactttacacgagagcctaatgattcgttcttttacgagaatgacggaatttttgattatcagcgtattcaacagcaaccaactcaattccagacaaagcagcgaaatgattcacaacagcaacggttttcacaggaacaaaatttcgaaattgataacgaagttgtccacaataacaatcgttattatgaatatgaaaggtcatcaaatgaagtctctccttttgatgatgagaatccaaatgtgttatctgatggcatgtcacccactattatggcaactgcaactgcagtaaccaacgcaaatgcgcctttaccagttaatgcacaagccaataatcctttgaattttacatcggccccaagtagaactgtttatttgggtaatgtgccaccaaacctaagcgttaaagagttattggatcatgtcagaagtggtgtcgttgaagacgtcaaaatcatacctgaaaagatgtgtgcattcgtttcgtttatagatgaaagtgctgcactattgttccattcagacgcaattttaaagcgcttgaacatcggtgacagggatatcaaaatcgggtgggggaaaccaactcgaattgatcctattgtagcggctagaatctctacggacggtgccacaagaaatgtatacattggccgtatgacgattgaaggcgaagaatcacatttatctgaggagcaattgagggttgatttagaagaatatggtgaaattgactgtataaaaattatcaaggaaaagggaatcgcctttattcattttgcgtctattttaaatgctataaaagtggttacgaatctgccaattagaaatccatactatcaaaataagagaatattttatggaaaggacagatgtgcatttattaccaaaactcaacaacataatgcggctcaatttctaggtgtacaacctggtatggaacatatgatagagttttctgatcgtgaatttatatctaacgctttgttacaacagtctgctgctgctgctgcaattgctacatctgcgggcggccccaataacttgggtaacaggactgtttacctgggcagcttgcctaaggatgttaaaattgaagaaatatgtaatgcagttcgtggaggtttattacaaagtataaaactattgaacgatcgatacgtctgttttgtaacattcattgatcctactgctgctgcgcagttttatgcaatgagttctttgtatggattcacagtccagaaaaaacgttgcaaagtcggctggggtaaacactccggcccattaccaaatgcgctcgccttggcagtcagtaatggtgcctcaagaaatgtttatgtgggtaatattgattttgtcggcgattccctaagagatgaacgtgtcttcaccgaaagcaacttaagacatatctttcagcaatatggggaagtggaacaaatcaatttcttgcctgagaagaactgttgtttcatcaattatactaacatcagtaatgctattttagccttagacaagattaagtctaacccctatttcaaagatctcaaaataaactttggcaaggatagatgtggtaacgtcccccaccaatcacgttaa

SEQ ID NO: 466 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataa

SEQ ID NO: 467 - DNA, 2091 bp, Saccharomyces cerevisiae
atggtaggctcgaaggatattgatctattcaacctgagagagaacgagcaaatcgtttctccttgtcttatcgtgcacggaaaatgcaataagcaaaatggtgcgaagaccgttcaagtgcagcatccacaattgcctccaattacttaccccatacataatcagttcttcaaggccactgtgatattgactcctggtgagaacaagttgacctttgttacagacactaacaccgctaggacaatcgtatgttactacacaccactgacgcagaaccctcccgtacacctgtgtctgatcttggccaaggattcgcctttacagtttgactctcctcgagaacagaaggacagagagggcgggaatggcctcgaattggcaatcaagaagctaagacttggggccagactcatgcaagcgtacacgaacgagcaaatgctgagaaacagtatgggaaataggacgtttccctttgttgaagaatttacctgggacacgctgttcgaacggcctgctatgagaaacaccatcaaaatacatgtagttcgttcggaaaagacggtgaaggaaatccaggaccctgacatagctcaacagaattccaaagggaaaaacaccggcgccctttttgggatagccatggacgcccttaaaagttacggcggacccttcaccaataacgaaaagcctgttcaggcagcttgtatgtttctagacacccactgggatggtaagttgattagaggccacgccgcattgggtgggggtgacgacagcattaagctcgccatttttgggtcgcacgggctttactcatggcctacttgtctcgagcaattggtgccttattttactgatgagacaagatcctccaccagtgaagtcgccaacgactgtaatgagtgtggtacttactgggaatgtttgactatcacgttgggagcatttatgcatgagattggtcacttactgggttgtcctcatcaggaaagcggtgttatgctaagaggctataccactttgaataggtctttcttgactaaagaggcttattctgtaagaactaattcaactggtgctagtcctcccatcttccccaaggaagaatgtacctggaaccgtctcgatacggtaagatttttgtaccacccctctttcactttaccacaggattattacgatccatcgttcatgagacctacaaaattgggcggataccccaatataaaacactctgtatatcctttgggtaacggcagttgccgcatattatcgcccacaggaatctatttgattgaaattatatgtgatgatttggccaggggccatattgaatacttgccggtttccctaggtggacaggggcctcaacgggaagttatagtaacattagatgatttacgtgccaggttgcccaagaatgaactcgccaagtttggcaataccttcaaattgaaaattctttctgttaatgcaccggaaaccgagttcgacaagttcccatctttgttagatgttcagccattagacatgtcgaaatatgggttttctaaaaatgttcaaggtatcaaatcaccactttatggtcgcagcgacggtggtaatgctgtcggcgtcgtcgcttttgatgttagattagtcactgctgtgagaatataccatggctatgcattagatggtgtgaggttttattacaaggaaaaaccaactggaacaaaggatgctcccgcatccaagccctctgtaccaccaagaaattatttctcaaaaattacacatagtatcaaaaatcatgcttcaataaacgaagaaaatctaaaaagtgtactctttggacatgaaacacaaaattttacggatgctacactagaaccgggtgaaataatcattgggtttaatctgaggtgcggagcttgggttgatgctatccaaattataacgagtcatgggagaatgaccgacatgtttggtaacaaagacggaggtgggttcgctgaattgcagccacctaatggccaatatatcctaggtgtgactggcagagtcggtcaatgggtcgacgccttcggaattatttacggagctttatag

SEQ ID NO: 468 - DNA, 1449 bp, Saccharomyces cerevisiae
atgagttttaaagggtttaccaaggctgttagtagggctcctcagtccttccgtcaaaagttcaagatgggtgagcagacagaggatcctgtttacgaggatgcagaacgtcgttttcaagaattggagcaggagacaaaaaaattaagtgaggaatcgaagagatactcgactgcggtgaatggaatgctgacacaccaaattggatttgccaaatccatggaggaaattttcaaacctatcagtggtaaaatgagtgaccctaacgctaccataccagaggacaacccacaaggtattgaagcaagtgaacagtatagggcaattgtcgcagaattacaggaaacattgaaaccggatctggctttggtggaagaaaaaattgttacgccatgccaggaactgttgaagattattacttatattcgtaaaatggccaccaagagaaatcacaaaaaattagatttagatagacatctaaacacttataacaagcatgaaaagaagaaggaaccaaccgccaaagacgaagaaagattgtataaagcacaagctcaagtggaagtggctcaacaagaatatgattactataacgacttgctaaagactcaattaccaatactgttcagtttggaagctgaatttgtgaaaccattatttgtctcattttatttcatgcaattgaacattttttacactttgtataatagacttcaagacatgaagattccatattttgatttgaacagtgacattgtagagtcgtacattgccaagaaaggcaatgtggaagaacaaacggacgccttgactattacacactttaaactcggttactctaaggcaaaattggagatgaccagaaggaagtatggtgtagcaaccgccgaaggctcacccgtcagtggcgcatcaagcggtgtcggatatggtgctgggtatgatccagcaactgccacttctccaacccctacaggatacggttatggtgccgcagcaccaagttacgccgctcaacctgctgcccagtatggtactgctgccgccgttggtactgctgctgctgttggtactgctgctggtgctgctgctggcgctgttccgggtacttatccacagtatgctgctgcgcaatctccaccgctcactgggctaggcttccaacaatcaccacagcagcaacagggaccaccaccggcctactctaatcctctaacatcacctgttgcgggcacaccagccgcggccgtagcggcagctcctggcgttgaaactgttaccgcattgtatgactaccaagctcaagctgctggtgatttgtctttccctgccggcgcagttatagaaattgtccagcgtactccggacgtgaacgaatggtggacaggaagatacaatggccagcaaggtgtgtttcctgggaactacgtgcaactcaacaagaactag

SEQ ID NO: 469 - DNA, 1245 bp, Saccharomyces cerevisiae
atggtaaatttcgatttgggccaagttggtgaagtattccgtagaaaggacaaaggagctatagtgtccggagacaacccagaagaagaagaagacgtcgatgcttctgagtttgaagaggatgaagtaaagcctgtgcgtacaaagaacagaagacccaaagaggatgcattcactcaacaaagattagcggctataaacccggtgttaacgccgaggacagttttgcctctttatctgttaattgctgttgtatttgttattgtaggagggtgcatattagcacagaactccaaagtggatgaagtaaccatatattaccaggactgtatgactaacgcaacctcatcatggagcgacatcccttctgaacattggcaatttgtatttcacaaatataaaacatataatactgcaccacaatggaggtttgtggatgatgaatcagatgacttcacaaaacaaagaggtacatgccaaatcaggttcactactccaagtgatatgaaaaataacgtatatttgaattatgtgctggaaaaatttgctgccaatcacagaagatatgtactatcttttagcgaagatcagatacgtggggaggacgcctcttatgagacggtgcatgatgcaaccggtataaattgtaagccactatctaagaacgccgatggtaaaatatactatccatgtggcctaattgcgaactcaatgttcaacgacacgttccccctgcagttaacaaatgtaggggatacgtctaacaactattcattgacaaataaaggaatcaattgggaatctgataaaaaaaggtacaaaaaaaccaaatacaattatacacagatagcacctccaccatattgggaaaagatgtatccagatggatacaacgagacgaatattcctgatattcaggattgggaagagttccaaaactggatgaggccaggtgcttttgataaaattacaaaactgatcagaatcaataaaaacgatactttgccagcgggtgaataccagttggatatcggtctgcattggccagtattggagtttaatggtaagaagggaatctacttgactcacggttctcaccttggcggtagaaatccatttttaggtatagtttacctgattggaggctgtatttgtgctgccatggcattgatattattaacgttttggctcttcggcggtagaaagattgctgatgcatcaagtttgtcatggaatatgaaatag

SEQ ID NO: 470 - DNA, 3219 bp, Saccharomyces cerevisiae
atgtccgagagtaacgcacacttctcatttccaaaggaggaagaaaaagttctatctctttgggatgaaatagatgcctttcatacttcattagaattaacaaaagacaaaccggagttttccttcttcgatgggcctccatttgccaccggtactcctcattacggtcatattcttgcttccactattaaggatattgttccaagatacgctaccatgacaggccaccacgtggaaagaagattcggttgggatacacacggtgttccaattgaacatatcattgacaagaaattaggtatcacgggtaaagatgacgtcttcaagtatggtcttgaaaactacaacaatgagtgtagatccattgttatgacttatgccagtgattggagaaaaactattggtcgtttgggtcgttggattgatttcgacaacgattacaagactatgtatccatcctttatggagtccacatggtgggctttcaagcaacttcatgaaaaaggtcaagtttaccgtggattcaaagttatgccttattctactggcctaaccactcccttgagtaactttgaagctcagcaaaactataaagatgttaacgacccagctgtgaccattggtttcaatgttattggccaggaaaaaactcaattggtcgcatggactacgactccatggactttaccttccaatttgtcgttatgtgttaacgctgatttcgaatatgtaaagatttacgacgaaaccagagatcgttatttcatcttattagaatctttgattaaaaccttgtataagaagcctaagaatgaaaaatataagattgtggaaaaaattaaaggttctgatttggttggtttgaagtatgaaccattgttcccatatttcgctgaacagttccatgaaacagcttttagagttatttcagatgattatgttactagtgattccggtactggtattgttcataacgctcccgctttcggtgaagaggataatgctgcttgtttgaagaacggcgtcatatccgaagattcagtgttacctaacgccattgatgaccttggtagattcacgaaagacgttcctgattttgagggtgtttatgtcaaggacgctgataagttgattattaagtacttaactaatactggaaatttgttattggcatcccaaattcgccattcctatccattctgttggagatccgataccccattgttataccgttctgttccagcttggttcgttcgtgttaaaaacattgtccctcaaatgttggattctgtgatgaaatctcactgggttcctaacaccatcaaggaaaagaggttcgccaactggatcgccaatgcccgtgactggaacgtttccagaaatagatattggggtactccaattcctttatgggtttcagacgattttgaggaggtcgtctgtgttggttctatcaaagaattggaagaattgaccggtgtgcgtaacatcactgacttgcatcgtgatgtcattgacaaattgacaattccatccaagcaaggtaagggtgacttaaagagaattgaagaagtttttgattgttggtttgaatctggttctatgccttatgcttctcaacattatccatttgaaaacacagaaaaatttgacgaaagagttccagctaatttcatctctgaaggtttggatcaaacaagaggttggttctacacgttagctgtcttaggtacccatctatttggctctgttccatacaagaacgtcatcgtctctggtattgtcttagctgccgatggtagaaagatgtctaaatccttgaaaaattaccctgatccatccattgttctgaacaaatatggtgcggatgcattaagattgtacttgataaactcacctgttttaaaagctgaaagtttgaaattcaaagaagagggtgttaaggaggttgtttcaaaggtcttactaccatggtggaactcctttaaatttttggacggtcaaattgccttgttgaaaaagatgtctaacatcgacttccaatatgatgattctgtgaaaagtgataatgtcatggacagatggattttagcttctatgcaatctctagtacaattcattcacgaagaaatgggtcagtacaaattatacactgtcgttccaaaacttttgaatttcattgatgaattgacaaactggtatattagatttaatcgtcgtcgtttgaagggtgaaaacggtgttgaggactgtttgaaagcattaaattctttattcgatgccttattcacatttgtccgtgccatggctccattcaccccatttttgtcagaaagcatttatttgagactgaaggaatacatcccagaagctgtcttagcaaaatacggtaaggacggaagatcagtccatttcttatcttacccagtggtcaagaaagaatactttgacgaggccatcgaaactgcagtttctagaatgcaatccgttatcgatttgggtagaaacattcgtgaaaagaaaactatttccttaaaaactccattgaagactttggtcatccttcacagtgatgaatcatacttgaaggatgtagaagccttgaaaaactacattatcgaggaattaaatgttcgtgatgttgttatcacctccgatgaggcaaaatatggtgttgagtataaagcagttgctgattggcctgtattgggtaagaagttgaaaaaagacgcaaagaaggttaaagatgccctaccatcagtcacttctgagcaagtacgggaatatttggaaagcggaaagttggaggttgccggtattgaactggttaaaggagatttgaatgctattagaggcttgccagaatctgctgtccaagctggacaagaaaccagaaccgaccaagacgtgttaatcatcatggatacaaatatttactctgaactaaagagtgaaggtctcgcaagagagctggtcaacagaatccaaaaattgagaaagaagtgtggtttggaagccaccgacgatgttttagtggagtacgaattagttaaagatactatcgactttgaagccattgtcaaagaacattttgatatgttaagcaagacctgtagatccgacattgccaaatatgacggctcaaagacagacccaattggtgatgaagaacaatctattaatgacaccattttcaaattaaaagtgttcaaattatga

SEQ ID NO: 471 - DNA, 324 bp, Saccharomyces cerevisiae
atgtttaacagtgaaattttcatcctcgaatttttcatcgtatatgctctcaccgccagtaccattaaaattggtaaaatcaccaaattgacacatgaagtctttgatcactctgtggaaaatggaacccttgtacgacaatggtacatcaggtttagtctttgccataccagcatttccttcacacaacttcaaaaaattttcagccgttttaggcactatgtcattgtacaactcaaaaactatacggccttggggtttacctccaatagaaatatcaaaaaaagttttaggtctagtcatttttactccttgatcgcctga

SEQ ID NO: 472 - DNA, 363 bp, Saccharomyces cerevisiae
atggtcaaactaacttcaatcgctgctggtgttgccgccatcgctgctactgcttccgcaaccaccactctagctcaatctgacgaaagagtcaacttggttgaattgggtgtctacgtctctgatatcagagctcacttggcccaatactactctttccaagccgctcatccaactgaaacctacccagttgaaatcgctgaagccgttttcaactacggtgacttcaccaccatgttgactggtattgccccagaccaagtgaccagaatgatcaccggtgttccatggtactccagcagattaaagccagccatctccagtgctctatccaaggacggtatctacactatcgcaaactag

SEQ ID NO: 473 - DNA, 1917 bp, Saccharomyces cerevisiae
atgtctcgtactaacatggatacaagacacgcacattctgctttactggcagcaccacagagtgctactgcaaatagcaggagcagcaacagcagcagcgagagtagtagtaacaaaaacaatatcaatgtcggcgtcggtgacgatagcggtaatgtcagcgcggtaagtatcgacgatggaccccacttcagggatatcttccactatggacacgaggaaaattacaaacttgcgagcagcggtatcactaacctgaattcttcatcccacgcccaccaaactttgtctcccatttccattagtaatgcatccactccggaaagttttcccgagcaccctttgggcctagaacgggaaacagagccggcgttggaagctgaaatggaagcggaggaactaccaccacaccaaagtaaataccttttaagctccattaaggcgaccaaacgattaaaagatgctagaccgtttctgaagccggttgatcctattgctttgaacatcccgcattatttcaactacgttcaaaccccaatggatttgtctttaattgaaacaaaattgcagggcaacgtgtatcattcagtagagcaagtcacatcggacttcaaaacaatggtggataattgtttaaactttaatggtccagaatcttcaatctcttcgatggctaaaaggattcaaaagtattttgaaaaaaagttatctgcaatgccaccaagagttttacccgcttctgccttgaagaaaacaagcagaaaccggaaaaaaaatgaggatatggattccccacttgtcattagacgttcagttagtaccaccaatgacaatattggggaaagcggaaatagagaaggcgtcagtggtggtagacccaaaagaacaattcatccacccaaatcaaaagatttgtttgatatatatgaaaactccaaaccaaaatcaaagactttacaaaaaaaattcaggacttgtctgaaaatactaaaggttttgatgagtaaaaaaaattcggatataaattttccctttttacaacctgttgatccgattgctttgaatctaccaaattactttgatgtcgtgaagaatcctatggatttgggtacaatatcaaataatttaatgaactggaagtacaaaacaattgatcaatttgtcgacgacctcaaccttgtcttttataattgtttccaattcaatccagaaggcaatgaagtccattcaatgggcaaaaaactaaaagagcttttcaattttcattggttagagaaccaggatattttgaatgaaattgaaacggattcagatcttgaagaggataactattcttcttcatattcatctgatgatgaatatgatgatgaagacataaatgaaaacgatataactaatccggctattcaatatttggaacaaaaactgaagaaaatggaggttgaattgcaacaattgaaaagacaagagttaagtaaattatcgaaggaaaggaagaggaagcatctaggtaaaacgcttttgcgtaggaaggcaatgaagcattcagttgacgatttaaagaaatctattactgataaaatcaatgaattaagtgatttagaaatgaatgggatgattcgtatcattaaaaattcattacccgcagatgaaatactaacttccaatgaagatgaaattgaaattgatttggatattttagatgaagcgactattgcaagaatttatgagagatattttgagaaaaaaaataacaacaatagcaaaagaaaactaagtggcaactactcgactgcgccaactaacaagaaaaagaaaaccttgaaatttttggaaaaggatgaaatcataaataataataattattccgattctgaagaagacagtagtgatagtagcgacagtgacagtgattaa

SEQ ID NO: 474 - DNA, 1152 bp, Saccharomyces cerevisiae
atggctgcaagtgagataatgaacaatctgcctatgcattccctcgattcttctctaagggatttacttaacgatgacttattcattgaaagtgatgaatcgaccaagtcggtaaatgatcagaggagtgaagtatttcaagaatgtgtgaaccttttcataaaaagagatatcaaggattgcctagaaaaaatgtctgaggttggatttattgatattaccgttttcaagtccaaccctatgatattagatttatttgtcagcgcctgtgatattatgcccagctttaccaaattaggtttaacactgcagagtgagattttgaatattttcacgttagatacccctcaatgtattgagacaagaaaaattattctcggtgacctcagtaaacttttggtcatcaataaattctttcgatgctgtatcaaggttattcagtttaacttaactgatcacaccgaacaagaagaaaaaactctggagcttgaatccataatgagtgatttcattttcgtatacataacgaaaatgaggacaactatagatgtagttggcttacaagaattaatcgagatattcatctttcaggtgaaggtaaaactgcatcataaaaaaccctcaccgaatatgtattgggcgctttgcaaaacattacctaagttatctccaaccctaaagggcctttacttatctaaagatgtttccatagaggatgctattctgaactcaatagataataaaatacaaaaagataaggcgaagtctaaaggtaaacaaagaggagtgaaacagaaaatacaccattttcacgagcctatgttacacaatagtagtgaagaacaggttaaggttgaggatgcgtttaatcaacgcacctctactgatagtagactccagagtactggaacggcgccccgtaaaaaaaacaatgatattactgttctggctggttcattttgggctgtcctgaagcatcatttcacaagaagtgtgctgaacaaaaacggacttctgctcacaggtctgctgctactcttatgtttgaaaaaatataagtcattgatggcaattttcaaacatgttccagcggcctttcacactgtatacccccagattgtagggttgctaaaacttctagcgagtatatga

SEQ ID NO: 475 - DNA, 2106 bp, Saccharomyces cerevisiae
atgaacggcattgatgatctcctaaatattaacgacagaattaagcaagtgcaaaatgagagaaacgaactggcatcaaaactgcaaaatctaaagcaatcattggccagcaatgacacagaagtagcattatcagaggtgatagcacaagatattattgaagtaggggctagtgttgaggggcttgaacaattaagggcaaaatatggtgatctgcaaatcttgaataaattggaaaaggtagctgtacaacaaacacaaatgcaagctggcgtagacaaactagatagttttgaacgtcagttagatgagttagctgaacaaccgccggatcaattcactctagatgacgtaaaggcgctacactcaaagttgacgagtgtcttcgctacagttcctcaaatcaataatatagattctcagtatgctgcttataacaaacttaaatcaaaggttaccggcaaatataatgacgttattatacagaggttagctactaactggagtaatacgtttgatcagaaattgttagaagcgcaatgggatacgcaaaaatttgcatccacatcagttggtttggttaaatgtctgagagaaaattccaccaaactttatcaattaagtctgctctacttacctttggaggaggaaacacagaatggagatagcgaacgcccactttcacgctcaaacaataaccaagaacctgtgctatggaattttaaatcactagcaaacaatttcaacgttaggtttacgtaccattttcacgccacatcgtcatcctctaagattgagacgtattttcagtttctaaacgattatctagcggaaaacctatacaagtgcatcaacatttttcatgatgactgtaatgggttgacgaagccagttattcatgaacaatttattaattacgtcttacaacccattagggataaagtaagatccaccctatttcaaaacgatttgaaaactttgatcgtcctaatttcccaaatcctggctacagacaaaaatttattgaattcttttcattaccatgggctaggtttggtgtcgttaatttccgatgaagtatgggagaaatggatcaactatgaagttgaaatggccaataggcaattcatcaatataactaaaaatccggaagatttcccaaaatcttctcagaattttgtcaaattaatcaataaaatttacgattatttggaaccgttctacgatttggattttgatctattagtaagatacaaactaatgacttgttcattaatttttatgaacttgacttcatcctacttggattacattttaactgtcgattcattgaatgaaacaagaactaaagagcaggaattgtatcaaactatggcaaaactgcaacatgtcaactttgtgtacagaaaaatcaaatctttgtcttcaaacttcatttttattcaactgaccgatattgttaacagcacagaatctaaaaaatacaattcactgtttcaaaatgtggagaatgactatgaaaaagctatgagtacggatatgcaaaactccattgtacacaggattcaaaaactgttgaaggaaaccctacgaaattacttcaagatttcaacttggtcaacattagagatgtctgtcgacgaaaatatcgggccgtcgtccgtaccaagcgctgagttggtcaattcaattaatgttttgagaagattgatcaacaaattggattcaatggatatcccactagctatttcattaaaggttaagaacgaattgttaaatgttattgttaactattttacggagtcaattctaaagttgaacaaatttaatcaaaacggtttaaatcagtttttacatgattttaaatctttaagcagcattttgagcttaccgtcacatgctaccaattataaatgtatgagtttacacgaactagtaaaaatattaaagctaaagtatgatccaaacaatcagcagtttttaaacccagaatacattaaaacaggtaatttcacatcattgaaagaagcttattccattaagtacttgaaggacacgaagattcaagatgcactctataggattatatatggtaacatattatag

SEQ ID NO: 476 - DNA, 1692 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 477 - DNA, 2685 bp, Saccharomyces cerevisiae
atgaagttctcgcattccttacaattcaattctgtaccagaatggtctaccaagtatctggcctattcgcagctgaaaaaattgatctattctttgcaaaaagataagctgtacagtaacaataagcaccatgttgtggagccacatgacgccaacgatgaaaatctgccgctattggcagatgcttctccagatgatcaattctacatctctaaatttgttgctgccttaaaccaagaattgaaaaaaattgataaattctacatatctcaagaaacaggtcttatcgccaactacaacgaattgaaggacgatgtcatggaactggaaaacacgaacaaggccacccaattgtttaatcagcagcaacagcatcaactgcaaagtgttgcaagaaacaggaagtctaagtcacaacaacgccaaagaaggtttagtagtgtctcctccacggactccaacccctctctgacagacatgtcgattgactctgcacccgtcatccacacgcaggtctcgaacacgactaataatggtaactcaatgcaaaacctggcctccgcttcagtgtcgctttctaactctaaccctgtgtatctttctccttttacccaacataggctctctttaaagaaaagattgatatcgatctacacccagttgtccgagttgaaggactttattgagttgaaccagaccgggttctccaagatctgcaagaaatttgacaagtccttaaatacgaacttgaagcagaactacttgaactatatcaaattccattcgcatgttttcaatcctgctacaataaataggattcagcatcacattaccgagaccatcctcacttacgctagcttgaacaagggcacgcgtcgaccatctaatacgtttaacttggacgctgaccgaatcaacaatgacgaaaacagcagcggtaatgaagaagacgaagatggcaacagacaagaagtcctcgatttccaggatgctgagcgtgaattatcctctcatttgagagatcacgtagtttgggaaagaaacaccgtttggaaagatatgatgaatttggagagaaagtaccaatctgccaagactgacaacaagaagttttcaaagttgagttccagtcaattgcgccccaatgccaacattactgaatccatggcaatgtcgagtggtggcgccggtatcatcgctccatcaacggattccctaactttccgtgaactcatgcatttaccacccaagcaatggttgcaatttatcatgggccaaacttccctgctgaagtttctgttaatcacctcatgtttcattgcattattaacttttaatttgactccttttacgcaggattccttacagaaaaactgtttcgccatcttaatatatgcatctttattatgggccactgagaccatcccccttttcgtgacttctctaatgattcctctgcttattgtagtgttccctgttatcaaggaccctatcacctcccaaccaatgtctccccgtgattcctctcagttcatcttatcaacgatgtggtcgagtgtcatcatgcttttgctgggtgggtttactttagcagccgccctttccaagtacaacattgccaaagtcctttctacgcatattttggcatccgccggtacaaacccacattttattcttttaacaaatatgtttgtggcgctctttgtttccatgtgggtttctaatgttgctgcccccgttctttgctattcaattgttcaacctttgctcagaacactgccaagaaattgttcctatgccaaagctctaattcttggtatcgctcttgcctccaatatcggtggtatgtcttctcccatcgcttctcctcaaaacattttttctattggtataatggacccttcaccatcttgggctgaatggtttatgattgcgctacctgtgtgctttatttgtgtcatggcaatttgggtgctattgatcataaccttccctcctgagccaaatgtgaaaattttgcaattgcatccatcccgtgatccattcactctgaagcaatggtttgtcactttagtttgcattataacaattgttctttggtgtctttcaaaccaaatctccggtatctttggtgaaatgggaatcatatctattatacctatagtagtcttcttcggtacaggtcttctaacttcggatgatttcaataatttcatgtggacaatcgttgttttggccatgggaggtaccaccctaggtaaggcggtaagctcatccggtttattgtctacaatggcacagttaattaaggcgcaggttgagcatgaaccaatcttcattattgtgttgatcttcggtctagtgattcttgtaatggccacttttgtctcccataccgtcgcggcaatgatcatcgtaccattaatgagtgagatcggttccaatctaccttcaggtgatcattctagactattgatcgttatagccgccctattatgctctagtgctatgggtcttccaacctctggtttccccaacgtgactgccatttcaatgattgatgaagttggtgatagatatttgaccgtgggtacatttattacgagaggtgtaccagccagtttgttaagttatgccgctattgttacagtaggttatggcatattgaaagtaatgggattttaa

SEQ ID NO: 478 - DNA, 4086 bp, Saccharomyces cerevisiae
atgtggggaggtggcaaaatggcagtagtaagcttgtcgccccacacggcgaagatgcgtaaactatttgggcaagctagcacaacgatggcttatgacggtttaaaacgagaggctgaaagaagaacaaggagtgaccataacataacaatggttgctaaagatgatgagctatacttgtaccatcttactttaaagaaacagacgaatttcgtgcactcctgcatcggacacttcgtcgatctggaagcagggtccaagcgtgagcagtcgcaattgtgcgtagctactgagacgcatttagaactttatgatactgcagatggggaactaaagcttattgccaagtttcaaaacctgtttgcgacgataacctcgatgaagtcgctggatctgccgcattcagggtcaagggcaaaagcttccaactggcccacttttctagcgctaacttccgattctggtaacctaagtatcgtgcaaatcattatgcatgcaggtgctcttagacttaagactttagtgaaccagccattgacgaggaccacccttcgaagagtctctcccatatcatacatggaaattgaccctaatgggcgttgtatcattctctcatctgtcgaacaaaataaattgtgtttcctcgttgattatgctcaaaaattgaggatttcgtctccattggaaatcatcagaccccatatggtaacgctggatatggcagttgttgatgtaaatttcaataatccatgttttgttaccttagaaatcgacaatgccgctactcaactatcagtacacttgatattttatgtcctcgagttgggtttgaatcacatcgtcaagaaggcagattatttagttaacccatctgccaatttcgtactgagtttgccagatctatcgcgatataatataacaacttcgctaagcgacaacaactatgatgctgactatgatacccttttcaacccttttgttgtcataggcttcgaaaatcatattctggtaaaggatatgaacggatttttcagcctgaaagtggaaatacccaaaagatctatcacaaatagccgtcataaaaatgtaacaatcatatcaggcatagtgcagaaattgaaaaatgattttttcgtacttttacaatctaaccatggcgatctttttaagttaactgtaagtccagacactaatgatagaaatagacctttagttcaattgtcctactttgatacaatccaaaattcacaccaattacacattttcaaaaacggttatctttttgcactatctgaaatgaataacaactttcttttccagtttgagaaacttggtgtagagaaaaatgatttttctaatgttttaacctcaaaagatccaaataagtcgctagttttcgaaccatccataaagttgcagaatttgagcatattatcgcaacaattgaatttgaacccttcaataaaatctcaaattgtcagtgattcgccactgtctatcgccactaaacattttacaaacaacaagataataactttaacaaatgctgtgaattactctaatttgatatctactagtttacccccgaacgcaaccaagttatggctaatacccgatcctgcaacaaccggcgataacaatactcttttgttcataacttttcccaagaaaactatgatactacaaattgacaacgagtccatggaggaactaacaccggatgaagcaacgcgttcagctttcaagctctctcaggacacaacaattcatacatgcctaatgggctcacactctattatccaagtatgcaccgcagaactaagacatatcgtaccgactggtaaatctaggtattctaataagctgacttgggtgccaccagcgggaattcgtattgtatgtgccacgtcctcgaaaacacaactaattatatcattatcaaattacgaattggtttatttcaagatagatgtatcttcggattcgttaatcgaattaaccacccacccagaattggacacaatgccctctaaagttgcgattgtgcaagatacgcagcatgctgatttattagccattgctgacaatgagggtatgatcaaaataatgtctcttaaagaccaaaaggaagattttttaactgtaataagtttgcaattagttagtgaaaagatttctgacatgataatggttagagattcctcaataggacagcttaatttgcatgtaggtttagaaaatggcgtttacatgaaatttcatataggggatgttgacggatcgttcactgacataaaaaggcgattccttggcttgaagcctgtttccctttcgtatttgcgtgagatatctgtatcactaaataatgaggaagaagaagaagaagaagaagacgatgatgatgaaaaagaagaagaagaaataaatagtagtggagctaaatggatgtcatgcgtggtttgccattcctcttctacatgggtaagctacacgtggaaaaatgtgtggaccatacggcagttaaaggatcaaaacatgctaagttgttccaaatttgttaacgcagatgttgcaatcaacggtgtttgttcaatatcgagctcaggacgcttaaatattggcagagtttccaactttccaactttggataactggtttcacgttcatgaatcaagtgttaacaagcaagagaacggtggaggagatgaaagcaatgaagaggaagaagatgaaatggaagaagaaatggaaatgttacaaatatctacattccgacctcgtactattttatcatttcccaataatccgaaaagcattttgtttattgataatcacagtggtaagaaacaatgccgtatatcactgcaaattgatggtgaatgcttaaagtttggcagttcggatcatttatacaagatactggacgatatcgattgcgtttccgctgctataatagatttcacaagacaagctgatcatttgatcatttgtgctggcgacaaaaggctgttaacatacaagatattagttaacaaagataaactatcttttgatattgaattacttcaccaaacagaaatcatttcaccaatacatgctatgttgaagtttaaaaacttcttgctgacagccatgggctccactattgtcctttatggtttggggaaaaagcaattattaagaaggtccgtaacacagaccccggtatccataacaaaaattgtgtctatgcaccagtggaattatgaaagactggccgttggtgatatacatgaatctgtcactttatttatctgggatcctgcggggaatgtatttattccgtacgtagatgactctgtaaaacgccatgtgacggtattgaaatttctagatgaggcaactgttataggcgctgatagatatggaaatgcgtggactttaaggtctccaccagagtgcgaaaaaatcatgtcaaatcatgatcccagcgaattatctaatggggccatcaagtacccactagacgtcatcactttacagcagaaattacccaatacttatgattgcaagttcaagtttcaactactgaaccacttctttgttaatgatatcatcactgatttccatatcctggacagcctttcaaattctgatagacctggttgtatctatatgggcttacaaggaaccgtgggatgctttatccccttattatccaaggggaatgtttttatgatgggaaacattgagaatataatggctgaggcggatgatacgttttatttagattatgaatcaagaaagaagaataacaatatgcgtaaggaagacgatgaagaggaatctggaagtgttgtgttacaaggacggcatggtatagaggatgaaataatatgtgagggttcctgttccattttaggtagagaccaccaagaatacagaagctattatgcccctgtacgtaaagttattgatggtgatttatgtgaaaatttcctgagactttccttgaatgagcaggaatttttggccaaaaatttaaagagtgtacaagtggaggatataattcaaacaatcaacgaagtcagaacaaattacatgtaa

SEQ ID NO: 479 - DNA, 2109 bp, Saccharomyces cerevisiae
atggtgagcatgttctcattatttctgctattaattgagcaatcgccgcttgtagcgtcattgcaacaaagtcaacggcatatagtgggtgttccctgggaaaagcagcacttgtatgactcgaatgaaccagatttgactaaatggcactgtttgaaccacgaagatatcgtattggatataagccagattaatgatggggtttgtgattgtcctgatggttcagatgagcccggcagcgccgcctgcgtggaagatatattcaaaagcgttgcagagggaggtggtaaagtgaataagtatttttattgtgataacaaggggtttattccaagatatatacgaaaatcggaagtcgcagatggtatttgtgactgctgtgactgttctgacgagctactttctggatatgagctctttgatgctggatctaattgttctcagttaaaaaacgaatttgacattatggcctctaaagagttatcaagttaccgggaaggtaaagaggccctagaagaactggaaagaaaatacggtacaaaggaagaggctatcacccgtggtaattgcttagaagaagataaggaaaaagcttctgccgagataaaagtactctccaacaggctctcagaaaatcgagccaaattagagcagttgagaggcgagtactttaaccaattaagccatgatcccattttgtatcaatttgaacaattaaacagtactcgtttgggatcggacatccttacatcgttcactatggtttcaagagtaagtaaaggttaccaggacatattcaagattttaagtgatttatcagaggcctatactccctcgctaaatgataaagttgtcaatgataatattaaaaaattcagaaaagttagaagacgggctgaaaaggctaaaattaatgcagatagcaaaattgatgatgagcaggcagataatctttacttgtactttacagaagaagtacctcaaatttttttgaaaagagaatctgagaacacgttgaggtacgtcataggaaaatccaattttgttcaagcgctagtggagggtaaaattaactataccaacgatatcttggagtatatcagagaattccgtttgattatggatgatatttctcagaattacaatgttaactttcaagatgcaggggtcaaaagtgctgtcgattcgtataaaaactacctaggtgaatacggcgaactggctgaattagaaccagctcacccgtcagagagccttttgagatcgttgagcgaagtaacatcatttgtgaacgagaatgcaccaaaggtattgccaccagacgctgttgagtcagaacaagatacgaacagcgatcatatcggtacttctggagatttgcgcaataaactcaaagagattctatctaagctgaatattttttcatctagaaaagatttggtctcattagagaagagattccgctcttgtgaaagtcaagtcagtctcctggagaatgaattaaagcaaaaaatggactataagaaattattagatgaaactgaagatgaaggaactaattctactgcaggaaatctgactgagcttttagaactaatgggatcacaatcctattgtcttgacgacatactggacaactatgtgtacactatatgctttcaacgtccaatgaccgaaggtgtcatatatcaagctgaggataaggttgacggtaaaaaagttttgatcggtcgttttaagacatcaggttttaatgttgacttaaacatggaaaaatacgcagaacatttaaaggccacatatgatgagaagagtgatttgatttcaaacttagcagctatacaggacgatgacggtaacatgcaacattacgtattcgggaacttaaacgaactgaataatggtctggtactagaatacgaaaatggagaccagtgctggaatggtccgcgcagatcggctactgtatttgttcggtgcagcgacaaattcaagattcggagtgtacatgaagcgactaagtgcaactacatcttcgatgtcgttggtcctctaggctgcaacaagactttcgaatacgagccccctaagttcaatttaagtgaatga

SEQ ID NO: 480 - DNA, 1368 bp, Saccharomyces cerevisiae
atgactatatctactcttagtaacgagaccacgaagagcggatcttgcagcggccaaggcaagaatggtgggaaagactttacgtatggaaagaagtgcttcacgaaggaagaatggaaggagcaggtggccaagtattctgccatgggcgagctatatgcaaataagacaatacattatccgctgaaaattcagcccaacagcagtggcggctcgcaggacgagggatttgctaccatacagaccacacccatagagcccacactgccacggcttctgttgaactactttgtttctatggcatatgaagactcgagcattaggatggccaaggagctgggatttatacggaacaacaaagacattgcggttttcaatgatttgtacaagatcaaggagcgtttccatatcaaacatcttattaagctggggcgtatcaatgaggcgatggaggagataaactctatcttcgggctggaggtgctggaagagactttcaatgctacgggaagttatacgggtagaactgacaggcagcagcagcagcagcagcagcagtttgacatagatggagatttacacttcaaactgctgttactgaatttgatcgagatgataagaagtcaccatcaacaggagaacatcaccaaggattccaacgactttatactcaatctaattcagtattctcaaaataaacttgcaataaaggcttcgtcaagtgtcaaaaagatgcaagagttagaattagcaatgactctgctgcttttccccttgtcagattcggcggacagcggcagcattaagctgcccaaatcgttacaaaatctgtactcgatatctctaagatctaagatagcagatctggttaatgagaagctgctgaagtttattcatccaaggattcaatttgagatcagcaataataattccaaatttccagatttgttaaattccgacaagaaaataattacgcagaacttcacggtgtataacaacaatctcgtcaatggttcaaatggtacaaaaataactcacatttcgtctgaccaacctatcaacgaaaagatgtcaagcaacgaggtcacggctgctgctaattcagtttggctaaatcaaagggatggaaatgttggcacaggttcagcggcgacaacttttcataacttagaaaataaaaattactggaatcaaacttctgaattgctttcctcttcaaatggaaaggaaaaaggtttagaattcaataattactactcttccgaatttccctatgaaccaagattgacgcagataatgaaactgtggtgttggtgcgaaaatcagcttcatcacaaccaaataggggttcctagggtcgaaaactga

SEQ ID NO: 481 - DNA, 2115 bp, Saccharomyces cerevisiae
atggatgagcatttaatttctactattaacaagcttcaggacgctttggcgcccttaggaggaggatctcaatctcctattgatttaccacagatcactgttgtcggttcccagtcgtcaggaaagtcgtccgttttggagaacattgttggtagggatttcttgccaagaggtactggtattgtcaccaggagacctttagtgttacaattgattaataggagaccaaaaaagtcagaacatgctaaagtaaaccaaactgctaatgaattgattgacttgaacatcaacgatgatgacaagaaaaaggatgaatcaggaaagcaccagaacgagggacaatctgaagacaataaagaggaatggggtgaatttttgcatttacctggtaagaagttttataattttgacgaaattagaaaggaaatcgtcaaagaaactgacaaagtgacaggtgccaattcaggtatttcttctgtgcccattaacttgagaatttattctccgcatgttcttactttgacgttagtggatttgcctgggttgacgaaggttcccgtaggtgaccaacctcctgatattgaaagacaaattaaggacatgttgttaaagtatatttcgaaaccaaacgctatcatattatctgttaatgccgctaacaccgatttagccaacagcgatggtttgaagctggctagagaggtcgatccagaaggaacgagaactattggtgtcttgacaaaagtcgatttgatggatcaaggtacagatgtcatagatattttggctggaagagtcattcctttgagatatggttatatcccagttatcaatagaggtcaaaaggatattgaacacaaaaaaacaatcagagaagcccttgaaaacgaaagaaaattttttgagaaccatccctcttacagttctaaagctcattactgtggtacaccatatttggctaaaaagttaaactcaatcttattacaccacattaggcaaactctgccagaaatcaaagcgaaaatcgaagccacattgaaaaaatatcaaaacgaacttataaacttgggcccagaaactatggattcagctagttcggttgttttgagcatgattactgatttttccaatgaatatgccggtatcttggacggtgaggcgaaggagctttccagtcaggaactttctggtggtgctagaatttcttacgtattccatgaaactttcaaaaatggtgtagactctttggatccattcgaccagatcaaagattctgatatcagaaccattatgtacaatagttcaggttctgccccatctttgtttgtcggtaccgaagcttttgaagttttagttaaacagcaaattagaagatttgaagaaccatctctacgtttagttactctggtgtttgatgaacttgttcgtatgctaaaacagattatttcacaaccaaagtactcaaggtatcctgctctaagagaagcgatttctaatcagttcattcagttcttaaaggatgctactattcctacgaatgagtttgttgtcgatatcatcaaagctgaacaaacttacatcaatacagcccatcccgaccttttgaagggttctcaagcaatggttatggtggaagaaaaattacatcctcgccaagtcgctgttgacccaaagacgggtaaaccattaccaacccaaccatcgtctagtaaggcgccagttatggaagagaaatcaggattttttggtgggttcttctccactaaaaacaagaagaaattggcagctttggaatccccacctcctgttttaaaagctactggccaaatgacagagagggaaacaatggaaacagaagtaatcaagttgttgattagtagttatttctctattgtcaaaagaaccattgccgatattataccaaaggctttgatgcttaaattgattgtgaaaagtaaaactgatattcagaaagttttactcgaaaaactttacggaaagcaagatattgaagaattaacgaaagaaaacgacataaccattcaaagaagaaaagaatgtaagaagatggtcgagatattgagaaacgctagtcaaatcgtctcctctgtttag

SEQ ID NO: 482 - DNA, 2028 bp, Saccharomyces cerevisiae
atgaattttaaaatactcctcccgatttgtgctttattgacacttacaacatttctgttgaccattattgcaactgcgggttctacctcaaattataagccaataacgaacatttatatcggtgatgctgatatatcaaaaatcaacgttacaaaagttatgccacaagttggcccaattttgactgtgttaggttctgctctaaccgctccaaatacaacggtggataccatcttcggcgctcttaaggcaatcgcttctaccgaagccttgtctcctttactgcacttgttgtctaatgctgctaacacttcagccacattatcatctttgacacagttggctccaatggctttgctaggaaccaataccgctactaccacgaccttctccgctcttgatgagttattgactacctctaaaaacacaaccgaactcttggatgggtttagcacattgatgtcatctatgtcaaccaacacttcttctacttcggcttccttagaaaatactgttctaaccctattagtggattcgaccaatcctataggcactactgagtctttgatcactttaaataatatgaccacagaagaaaagacaaaattgtcgcctgtattcgagttattcgcaagttccaagaacattactgccacatgcgatgcgttagaaaccataatgaactctaccattccaacttcaacggtctcctcattgttttctagtctaaaaaccagtcttgcggaaggtggcaatgctactgaaactattatgcaattaggctccctcgttccttcgagtttaaaaccagctgtccaagctgttgttactctgtttgatgaaactacatctcaaaatgtaacattatccgtattgagcactatgattgccgaaaacattacccaatcatcttccgctaaagctgccatgggtgctttgactgacttgttgaattacactacaaaccaaacagagctgctaacatctgtcgaaagtttggccctctctaaagaagccgcttcctctactaaccaattggtggcacttgatgaaatcctttctgcaagtgctaacgcatccacagttgtttccataatccctactttggaatcccaattggccaataacaccgtattacttaagtacgttccatacttgttcagcctattagctgcgtcaagcgaccccgtgtcaagtttctcttctctggttaatatcaccaaatgggcagaaactaatgccgctacatttatgcccatgttgaaaattttaaactctgctgtaaacatgacaactatcacaccagaacaactcaaggaaatgactccttctatccttgaatatctacacatccctgtcatataccgtttgtccattttcacaatgtgtcgtgctcacttaaacagaacaatgtactcgtgtagcaagtcacacgctgttcaaaacatggatttccggtcgattgtttacaacaacattgaaggctcggactttaaaccttatatggatgccctgaacatcggtaaggacgatttgcatttagatggtgaattacaagacagacaacacatgtatgtcccagcagtgaaagcagctttagctatgaacttaatgtgcataatcacatccttcttcttaatggtattcttgttgctactaagtagacgttccgtggtgagtcaaaaattatggttggcattgggctttatttcctgttggatatgtattttcagcgggttgggaagcacaatctttagcgtcatccttaatatgatgaaatccggctccaagaaggacaattacgatgtcattatttctggctcttctccattttatggcctaatgtggtctggatttgtatttgccgtccttgtatttctctgcattgcatactgctggtggagcagcagaaagggagctgccatcgtggaagctgagaaagctgttcaagaaagtgactctactacctcaagaatcattgaagaacacgaaagccccattgatgctgaaaaaaactttgcaaggtaa

SEQ ID NO: 483 - DNA, 3195 bp, Saccharomyces cerevisiae
atggatgattatcacgtaaatactgccttctcaatgggcagaggtaaccagcaggatgatggcaatagtgaaagcaacagcatgcatacacaaccaagcactatggcgcccgctacgctgagaatgatgggaaaaagtccacagcagcagcagcagcagaacacaccgctaatgcccccggcggatatcaaatacgccaataatggtaactcacatcaagcagagcaaaaggagagacaagtagaacttgaaggtaaatcgagagagaatgcaccaaagccaaatactaccagccagagtcgagtttcgtcttctcagggcatgcctaagcagtttcatcgaaaatcgttaggagattgggagtttgttgaaacagttggtgcaggttctatgggtaaagtgaagctggcaaaacatcgttacactaatgaggtttgtgcagtaaaaattgtaaaccgtgctacaaaggctttcctacataaagaacaaatgctgccaccacccaaaaatgaacaagatgttttggagagacagaagaaattagagaaggaaatatctagggacaaaagaactattcgagaagcgtccttgggacaaatcttatatcatccacacatatgtagactttttgagatgtgcacgttgtcaaatcatttctatatgttgtttgaatatgtttcaggtggtcagctgttagactatatcatccaacatgggtcaatacgagaacaccaagcgagaaagtttgctaggggtatcgcgagcgccttaatatatttgcatgctaacaacatcgtccatagagatttgaagatagaaaatataatgatttcagattccagtgaaatcaagataattgattttggactttcaaatatttatgattctaggaagcagcttcatacattctgtggctctctgtattttgccgctcccgagctgttaaaagcgaatccttatacaggacctgaagtagatgtctggtcatttggtgtagttttatttgttttggtatgcggtaaagtgccatttgacgacgaaaattcgagcgttttacatgaaaagatcaagcaaggtaaggttgaatatccccaacatttatctatcgaagtaatatcactgttatccaaaatgttggtagtagatccgaaaagaagagccacacttaaacaggttgtggagcaccactggatggtaagagggttcaatggtccccctccttcttacttaccgaaaagagttcccctaactatcgaaatgcttgatataaatgtcttaaaagaaatgtaccgtttagaatttattgacgatgtagaggaaacaagaagtgttttggtcagtataatcacagatcctacttacgttcttctctctagacaatactggactttagcggccaaaatgaacgcagaatccagtgataacggaaacgcgccaaacataacagagagttttgaagacccaactcgggcatatcatccaatgatttccatatattacttgacttctgagatgcttgataggaaacatgcgaaaattcggaatcaacaacagcgacagagccacgaaaatatagaaaagctttctgaaataccggaaagtgtgaagcaaagggacgtagaggtcaatacaaccgctatgaaatcagagccagaagccacgttggcgacaaaagatacctctgtgccattcactccaaagaatagcgatggcacagagccccccttacatgtcttaattccaccgaggttagcaatgccagaacaagcgcatacgtcaccaacgagtagaaaaagttctgataatcaacgccgtgaaatggaatatgctctctctccaactcctcagggaaatgactatcaacaatttagggtaccttcaactactggcgatccctcagaaaaggcgaagtttgggaatatatttagaaaattatcacagcgccgtaaaaagaccattgaacagacatctgttaatagtaataatagtatcaataaacctgtgcaaaagacgcattctcgcgctgtttcagactttgtccctggttttgctaaaccgagttatgattcaaattataccatgaatgagcctgtcaagacaaacgatagcagaggtggcaataaaggtgactttccagcattgcctgcggatgcagaaaatatggtagagaagcaaagggagaagcaaattgaagaagatataatgaaattgcatgatattaataaacagaataatgaagttgcaaaaggaagcgggcgggaagcttacgctgcacagaagtttgaaggaagcgacgacgacgagaatcatcccttaccacctctcaatgttgcaaaaggtcgaaaactacatccaagcgcaagagctaaatcagttggtcatgctcgtcgtgaatcactcaaatatatgagacccccaatgccttcatctgcctatcctcagcaagagcttatagatactgggttcttagaatcaagtgacgataacaaatccgatagtttgggaaatgttacttcacagacgaatgatagcgtcagcgtgcattctgtgaacgcacacataaactcgccatctgtggagaaggaattaacagatgaagagatattgcaggaagcttctagagctccagccggttctatgccatccatcgatttcccccgttctttatttttgaagggtttcttttctgttcagacaacttcatcgaagcctttgccaattgttagatacaagattatgtttgttctgaggaaaatgaatatagagttcaaggaggttaagggtggttttgtttgtatgcaaaggttctcttccaataatgtggcagcgaagagagaagggactccaagatcgatcatgccactttcgcaccacgaatccattagacgtcaaggctctaataaatactcaccttcttctcctttgacaactaattccattcaccagagaaaaacatctattaccgaaacctatggagatgataagcattcgggaacatctttggagaacatccaccaacaaggtgacggtagcgaaggcatgactacaacagaaaaagagcccatcaaattcgaaattcatatcgtcaaggttcgtattgttggtttagccggtgtgcattttaagaaaatttctgggaacacttggttgtataaagagctggcttctagtatattaaaagaactaaagttgtaa

SEQ ID NO: 484 - DNA, 1041 bp, Saccharomyces cerevisiae
atgcagaagagcatattgctgactaaacctgacggaacacaatcgaatctacacagcatcaaaacggaaacgcccaccacggtggagttcgactcggagcagatggaaaggggccacagggaaagaggtcgtagcaagaagaaaagaggcgaacgagactcaaacgtgagcagtctgtcgcggtcgagaagcagggccagtagccgcagcagagtaagggaggaagagttcctcaagtggaccgtgttgaggcaggacccctcgatgcggttgagggtcgtggatgtggattctgaagaggaaggtgagggcaacgacgaagatgacgacgacggcgacggcgacgatatggacgaggaagagtccgatgaagagcaagtgagcgatatagagaacgatttagagattgacgaggagttccactacgatctgggcatgaaagtgttacccaacttttgtaccagcataaacgaagtgctagactccagcaagccctggatagccaagtacgagatcagcatccgtggccacgaaaacgaagacgtgtctctggagcaactcgacggaggctacgtcagagccatgcaactactcaccaagggtgccggcgcagaggccgggaaccaaaggtccttcatcctctacacggacctgagcagcgagtccacctacgccctgacctatctcatgggcgcagctgtcaaccagggagacaccgtctacattgtccactgggagccctcgaagcccacggacgactcccagatgttcgccaacgttgccagaatcagaaagcacgtcatgcacctgtttgactgcgtcgcgggcgtgctcgacgacctcgacgtcgtcgtcctctccttgacccatccgtacccaaaacacctcctcaacgagatgatccacggcctcaagccagtcgccctgtgctgctccctctcggtcatcctgtccactctgcagaacttcgtctgctctgtgcccatcctcgcggttagaaagaagctgaaacgtgccaagcgcaagggcatcagcgagtga

SEQ ID NO: 485 - DNA, 2880 bp, Saccharomyces cerevisiae
atgtttggcaacaatagaccaatgtttggagggagcaacctttcctttggatcaaatacgtcatccttcggtgggcaacaatcgcaacaaccaaactctctttttggaaatagcaataacaacaacaattccaccagtaacaatgcccaatcaggatttggtggattcacttctgccgctggcagtaatagtaacagtttatttggaaataacaatactcaaaataatggggcatttggccagtcaatgggtgccacccaaaactcaccatttgggtcgttaaactcctcaaatgccagtaatgggaacacttttggaggatccagttcaatgggttcttttggtggtaataccaataatgcatttaataataacagtaacagtaccaattccccgtttggtttcaataaaccgaatacaggagggaccttgtttggttcgcagaataataatagtgcaggtacttctagtttatttggcggccaaagtacaagtaccactggcacattcggaaacaccggaagtagtttcggaacaggcttaaatggcaacggctctaacatatttggggcagggaacaactcacaaagcaatactaccggcagcttgtttggcaaccaacaatcttcagcgtttgggacaaataatcaacaaggaagtctatttggacagcaatctcaaaacaccaataatgcgtttggtaatcaaaatcagctggggggcagttccttcggatcaaaaccagttggttcagggtcgctgtttggccagagcaacaacactttaggtaatacaaccaataatagaaatggattgtttggtcaaatgaattccagtaaccaaggcagttctaacagtggattgtttggacaaaactcgatgaacagcagcactcaaggggtatttggacaaaacaataatcaaatgcaaattaatggcaataacaacaacagtttatttggaaaggcaaacaccttttcaaattccgcatcaggaggtttatttggccaaaataatcaacagcaagggtccgggctgtttggtcaaaattctcagacaagcggtagtagtggactttttgggcagaataatcagaaacagcccaatacttttacccaatctaatacaggaataggtctctttggacagaacaacaaccagcaacaacaatctacaggtttgtttggagccaaaccagcaggtaccacaggatctcttttcggtggtaattcatcaacccagcctaactctcttttcggtactaccaatgtacctacctctaatacacagtcacaacaaggaaatagtctttttggtgccacgaagctgaccaacatgccctttggaggaaatcccactgcaaaccagtcagggagtggaaacagtctattcggaactaaacctgcctccactaccggctcattatttggaaacaacacagcttctacgacagtaccttccacgaatggattgtttggtaacaacgctaacaattcaactagcactacgaatacgggacttttcggtgcaaagcctgattctcagtccaaacctgcattagggggagggttattcggcaattcaaactcgaattcttccacaatcggccaaaacaaaccagtttttggaggcacaacccaaaatacaggactctttggcgccaccggcacgaactcttcagcagttggttcaactggtaaactttttggccagaataataatacgcttaatgttggtacacaaaatgtaccacctgtgaacaataccacccaaaacgcccttttgggtacaacggcagttccttccctacaacaagccccagtaactaatgaacagcttttttccaaaatatcaatccctaactctattacaaatccagttaaagcaacaacttcaaaagtgaacgcagatatgaaaagaaatagtagcctcacgtctgcctatagacttgccccaaagccgttatttgctccctcttcgaatggcgatgctaaatttcaaaagtggggcaagacactggaaagaagtgatagaggaagcagtaccagcaattctattacggacccagaatcaagctatctaaattcaaacgacttgttgtttgatccagatagaagatatttgaaacatctggtgattaaaaataataagaacttaaatgtcattaaccataatgatgatgaagcaagcaaagttaaattagtgacgtttacaacagaatcagcttcaaaagatgaccaagcctcatcaagcattgctgcttcaaaattaactgaaaaagcacattctcctcagactgacctaaaagatgatcatgatgaaagcactcctgatcctcaatcgaaatctccaaatggttccacctctataccaatgattgagaatgaaaagattagcagcaaagttcccggcctattgagcaacgacgttacctttttcaagaataactactacatttcaccttccatagaaacgcttggcaataagtcattaattgaacttcgtaaaataaacaacctagtcattggtcacagaaattatggtaaagtcgagtttctggagcccgttgatttgttgaatactcctttggatactttatgcggggatcttgtcacctttggaccaaaatcatgttcaatatatgaaaactgttccataaagccagaaaagggcgaaggcattaatgtacgttgtagagtgactttatattcctgttttcctattgacaaagaaacaaggaaacctataaagaatataacacatcctctactgaaaagaagtatagccaaactaaaagaaaacccagtgtacaagtttgaaagctatgaccccgtaacaggcacctatagttacaccatagatcacccagttttaacttaa

SEQ ID NO: 486 - DNA, 1335 bp, Saccharomyces cerevisiae
atgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaattgagaaactgtgttactctcttttatttgattttaagggctttggataccatcgaagacgatatgtccatcgaacacgatttgaaaattgacttgttgcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgactacatcttagatgaaaattacaacttgaatgggttgcaaaccgtccacgactacgacgtgtactgtcactacgtagctggtttggtcggtgatggtttgacccgtttgattgtcattgccaagtttgccaacgaatctttgtattctaatgagcaattgtatgaaagcatgggtcttttcctacaaaaaaccaacatcatcagagattacaatgaagatttggtcgatggtagatccttctggcccaaggaaatctggtcacaatacgctcctcagttgaaggacttcatgaaacctgaaaacgaacaactggggttggactgtataaaccacctcgtcttaaacgcattgagtcatgttatcgatgtgttgacttatttggccggtatccacgagcaatccactttccaattttgtgccattccccaagttatggccattgcaaccttggctttggtattcaacaaccgtgaagtgctacatggcaatgtaaagattcgtaagggtactacctgctatttaattttgaaatcaaggactttgcgtggctgtgtcgagatttttgactattacttacgtgatatcaaatctaaattggctgtgcaagatccaaatttcttaaaattgaacattcaaatctccaagatcgaacagtttatggaagaaatgtaccaggataaattacctcctaacgtgaagccaaatgaaactccaattttcttgaaagttaaagaaagatccagatacgatgatgaattggttccaacccaacaagaagaagagtacaagttcaatatggttttatctatcatcttgtccgttcttcttgggttttattatatatacactttacacagagcgtga

SEQ ID NO: 487 - DNA, 1683 bp, Saccharomyces cerevisiae
atggtactacttaaagaacctgttcagccgctgcctcgatcatctctgttatataataatgcgagcaatagtagtagtcgtataaaagagacaagaaaagtcaaactattatataatcccttaactaagagacaaatccttaacaactttgaaattttagccactttgggtaatggacagtacggcaaagtgaaattagcaagagatctcgggacaggtgcgttggttgcaataaaaattcttaatagattcgaaaaaagaagcgggtattctcttcaattgaaagtagaaaatccaagggttaatcaagaaattgaagtaatgaaaagatgtcatcatgaaaacgttgtggaattgtatgaaattttgaatgaccctgagagcacaaaggtttatcttgtattagaatattgctcaaggggacccgttaaatggtgtccagaaaacaaaatggagataaaagcagtgggaccatcaatactcactttccaacagtcgaggaaggtagtgttggatgtagtatcgggtctggagtatttacattcccaagggataacgcatcgagatatcaaaccatcgaacctgttaatttcatcaaacggaacggtgaaaatatccgattttggcgttgctatgtcaactgccaccggaagtactaatatacaatcatcgcatgaacaacttttaaaatctagagccttagggacccctgctttttttgcacctgagctttgctccactgaaaaagagtattcctgctcatctgccatcgatatctggtcattgggggtcactatatactgcttgttgtttggaaagttgcctttcaacgccaattcaggattagaacttttcgacagtattatcaataaacccttagaatttccatcttatgaggaaatgttgaatggtgccacttcgggaatcacaatggaagaatacactgatgccaaagatttattgaagaagctgttacaaaaagatcctgacaaacggataaaactagcagacatcaaggtacatccgtttatgtgccattatggtaaaagcgatgcagcatccgtattgaccaatttggagacgtttcatgagttgaaagtttcaccgccctcttcatgcaaaagggtagaattggtcagcctaccagtgaattcatcattcgcctctttagatagcgtttatatggaaaattttgaccacaataaccttaggactggtgctgacagaaattcaacatattctccatcaatatacgacgcaaataccttatcaccctcagcatatcacaacatcggttctagagagtcatcctattcgtccttttcctctttcacatcatccaccgcttttgcatctcagatcagtattcaggatgccccagcaatcggtgatcaacaatgcttgataggtgagagtggaagttcattaagagtgaattcttgtgagtttccacaatatacaactatgtctcctgtaggagaatatccctttgagagtacggaagcaagtttgagctctactcttacgcctgtcggtaatgtacctcaacgtataaaagcccacctggtagaagggaaatctaacagcaaggatgaccttagaatagaagcagacgcatcacttgtatttgaggctagcgacgcccagcgcacgagaagaagaatgtctctttataagctttag

SEQ ID NO: 488 - DNA, 2145 bp, Saccharomyces cerevisiae
atgacagaaattattgatttagacttggtcgatgactttatcaagaaacctatggtcaaacaacagaaaaaccagtcttcaaagcctagggtaaaaagaaggggtcagttgacctttgatgatttcagaaacatcaaaattgtagaagaacctgttgtactttctcacaatagttcaattgacgaatcactggatgctgctacccaaaatactaaaaagcgggagaaatatgaaggtacctgtgatgaagaaatgaaaactaaagaaatggaggcaaatatggcaagcaaatattctaatatcaaaacacattcgaacgacactaacaaggtagagtcgatcagtgaacacactacttctaataatagaccattgaatacattaaactggtcaccaaatattcctttacgatattctgactttgcaaagtttatgagtgatgagacggtaacggaaagcaattgggcgcctcccctttgcacccctctcccatatgcaggcgatgttatgaagatcctttcttttatcgtcaaatttaaatgggtgttcagcgacgatctactgaacctgtcatttcaagatgtggagataggactagaattaaaggtggctggccattctgcgaagaatattcgaatttgtcaggataaaatgaatctactattttgcagtcttttgaggttattattctgctccgagaaaagagcagacaaccaaactcatagaaatttcacgctaaaaagatttcttagtttgaaaaatccatatggaaaactggttggcaaactcagaagcttaatccaggagtggggcttaccaaaagaatggcgtggtaatagtgatattttatctactctaaattttaatggaggtggtttgttgacgatggaaccattagatagaataatattattgagatgcatgatcgattggaattgtagctactccgcacttttccataatgaaattcaaaggctcactcacttgaaaggcgatacagggttcaaccatcaaacttttcacgccagcaggtttgctatgtgcggggccaataacatattagatagttgtgaagttttatgctctttgatgagtcaaaagttggaaaatcgaaagaaaaggaagcccagcgacaaaggaaaactgagtaagatcaatagtcagatgaaatttctaaagggtgttcggaaatcattgagcgaaaaagtaactacagacagattacgagctgcagttaaaataaatgaagaatggggtgaatattttgcaaacgaatttacacacacaccaattgatgatcccaccgtagacgaaatttacaagttaaggacatcagagtttatgatagcgagaattccacgagttggagatttctacttaccaccattctggattggcaacgaatgcagttcagtaaacactagttacagtttcaatgacatgtcaacttatcttaattacttcgtaaaattcaaagaggagggtacaaaaatactgcctgcaaaaaccgcacaaaatgaaaacaagtgtcaacttaaacttatatataggaacactcctgcatgtatccgtaatttacagttcaatgatgttcactttgccgaggtgccgcattggtttgaagttgcaggagactcgaattctttgagcaacttcattgagtatttggaaagtttatcatcacttactgaaaatgacaccgatgatacaaaaaagggtatagacaatctaattgagtttttgaaaattttcagtatattcataaatgagactattcagcgcataactgctgcccctacaggcagtactgaaggacgtcatttgcgaacaagctctcagagaagaaccacggtgcattactcgagtgatgtaaatggtgacgtttccgaggaaagtgaaaatgaagttgacattgacgttagcgatgactatgattcagaatatctgagtgaggagaatacattgacaagaaaaggtgaagataggacagataaatcttttgggaaaagagaattacacaatggcgctaaagattgtgataggaattgtgatgatatagagatcttctcagaacccgttaggcaactacaagataattctcgggaaaaaagaagcttgaggcgtaatgccagaaaaggtctatag

SEQ ID NO: 489 - DNA, 573 bp, Saccharomyces cerevisiae
atgtccggtaaatggagactagtgctgaccgggataggcaatccagagcctcagtacgctggtacccgtcacaatgtagggctatatatgctggagctgctacgaaagcggcttggtctgcaggggagaacttattcccctgtgcctaatacgggcggcaaagtgcattatatagaagacgaacattgtacgatactaagatcggatggccagtacatgaatctaagtggagaacaggtgtgcaaggtctgggcccggtacgccaagtaccaagcccgacacgtagttattcatgacgagttaagtgtggcgtgtggaaaagtgcagctcagagcccccagcaccagtattagaggtcataatgggctgcgaagcctgctaaaatgcagtggaggccgtgtaccctttgccaaattggctattggaatcggcagagaacctgggtcccgttctagagaccctgcgagcgtgtcccggtgggttctgggagctctaactccgcaggaactacaaaccttgcttacacagagtgaacctgctgcctggcgtgctctgactcagtacatttcatag

SEQ ID NO: 490 - DNA, 615 bp, Saccharomyces cerevisiae
atgtctgcaaacgaattctactcaagtggccaacaaggtcaatataaccagcaaaacaaccaagaaagaactggtgctccaaacaacggtcaatatggtgccgacaatggtaaccccaacggtgaacgtggtttattttccactattgtaggtggcagtgccggtgcgtacgctggatctaaggtgtcgaacaaccattctaagttgagtggtgtgctgggcgccataggtggtgcattccttgccaacaagatatctgatgagcgtaaagagcataagcaacaagagcaatacggcaactcaaacttcggaggtgctcctcaaggtggacacaacaaccatcaccgtcagacaataacaacaataacggtggatttggcggtccaggcggccctggcggtcaaggtttcggaagacaaggcccacaaggatttggaggtcctggtccacaagagtttggtggtccaggtggccaaggattcggtggtccaaatcctcaagaattcggcggccaggtggccaaggattcggtggtccaaaccctcaggaattcgggggccaaggtcgtcaaggattcaatggcggttcacgttggtgaatggctcaacagagtga

SEQ ID NO: 491 - DNA, 633 bp, Saccharomyces cerevisiae
atgggaaaatcagccgttatattcgtggaaagagccactcccgctacactaacggaactgaaggatgctctctcgaatagtatcctgtccgtgcgagacccttggtcgatagactttcggacgtaccggtgctctatcaagaacctacccgcggatgtctccaagctcatgtactcgataacgttccaccaccatggccggcagaccgtgctaatcaaggacaactcagcgatggtgacgactgccgcagcggcggatatccctccggcgctggtgttcaatggctcatctacgggcgttcctgagtccatagacactattttgtcgtccaagctgtccaacatctggatgcagaggcagctcatcaagggtgatgccggtgagacgttgatcttggacgggctcaccgtgcgactcgtcaacctcttctcctccactgggttcaagggtctcctgatagaactgcaggcggacgaagcgggcgagtttgagaccaagattgcaggcatcgaaggacacctagctgaaatccgggccaaggagtacaaaacctcatccgactcgttggggccggacaccagcaacgaaatatgtgatttggcgtaccagtatgttcgtgctctggagctgtga

SEQ ID NO: 492 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 493 - DNA, 2865 bp, Saccharomyces cerevisiae
atggtccttttgaaatggctcgtatgccaattggtcttctttaccgctttttcgcatgcgtttaccgactatctattaaagaagtgtgcgcaatctgggttttgccatagaaacagggtttatgcagaaaatattgccaaatctcatcactgctattacaaagtggacgccgagtctattgcacacgatcctttagagaatgtgcttcatgctaccataattaaaactataccaagattggagggcgatgatatagccgttcagttcccattctctctctcttttttacaggatcactcagtaaggttcactataaatgagaaagagagaatgccaaccaacagcagcggtttgttgatctcttcacaacggttcaatgagacctggaagtacgcattcgacaagaaatttcaagaggaggcgaacaggaccagtattccacaattccacttccttaagcaaaaacaaactgtgaactcattctggtcgaaaatatcttcatttttgtcactttcaaactccactgcagacacatttcatcttcgaaacggtgatgtatccgtagaaatctttgctgaaccttttcaattgaaagtttactggcaaaatgcgctgaaacttattgtaaacgagcaaaatttcctgaacattgaacatcatagaactaagcaggaaaacttcgcacacgtgctgccagaagaaacaactttcaacatgtttaaggacaatttcttgtattcaaagcatgactctatgcctttggggcctgaatcggttgcgctagatttctctttcatgggttctactaatgtctacggtataccggaacatgcgacgtcgctaaggctgatggacacttcaggtggaaaggaaccctacaggcttttcaacgttgatgtctttgagtacaacatcggtaccagccaaccaatgtacggttcgatcccattcatgttttcatcttcgtccacatctatcttttgggtcaatgcagctgacacttgggtagacataaagtatgacaccagtaaaaataaaacgatgactcattggatctccgaaaatggtgtcatagatgtagtcatgtccctggggccagatattccaactatcattgacaaatttaccgatttgactggtagaccctttttaccgcccatttcctctatagggtaccatcaatgtagatggaattataatgatgagatggacgttctcacagtggactctcagatggatgctcatatgattccttacgattttatttggttggacttggagtatacgaacgacaaaaaatattttacttggaagcagcactcctttcccaatccaaaaaggctgttatccaaattaaaaaagttgggtagaaatcttgtcgtactaatcgatcctcatttaaagaaagattatgaaatcagtgacagggtaattaatgaaaatgtagcagtcaaggatcacaatggaaatgactatgtaggtcattgctggccaggtaattctatatggattgataccataagcaaatatggccaaaagatttggaagtcctttttcgaacggtttatggatctgccggctgatttaactaatttattcatttggaatgatatgaacgagccttcgattttcgatggcccagagaccacagctccaaaagatttgattcacgacaattacattgaggaaagatccgtccataacatatatggtctatcagtgcatgaagctacttacgacgcaataaaatcgatttattcaccatccgataagcgtcctttccttctaacaagggctttttttgccggctctcaacgtactgctgccacatggactggtgacaatgtggccaattgggattacttaaagatttccattcctatggttctgtcaaacaacattgctggtatgccatttataggagccgacatagctggctttgctgaggatcctacacctgaattgattgcacgttggtaccaagcgggcttatggtacccattttttagagcacacgcccatatagacaccaagagaagagaaccatacttattcaatgaacctttgaagtcgatagtacgtgatattatccaattgagatatttcctgctacctaccttatacaccatgtttcataaatcaagtgtcactggatttccgataatgaatccaatgtttattgaacaccctgaatttgctgaattgtatcatatcgataaccaattttactggagtaattcaggtctattagtcaaacctgtcacggagcctggtcaatcagaaacggaaatggttttcccacccggtatattctatgaattcgcatctttacactcttttataaacaatggtactgatttgatagaaaagaatatttctgcaccattggataaaattccattatttattgaaggcggtcacattatcactatgaaagataagtatagaagatcttcaatgttaatgaaaaacgatccatatgtaatagttatagcccctgataccgagggacgagccgttggagatctttatgttgatgatggagaaacttttggctaccaaagaggtgagtacgtagaaactcagttcattttcgaaaacaataccttaaaaaatgttcgaagtcatattcccgagaatttgacaggcattcaccacaatactttgaggaataccaatattgaaaaaatcattatcgcaaagaataatttacaacacaacataacgttgaaagacagtattaaagtcaaaaaaaatggcgaagaaagttcattgccgactagatcgtcatatgagaatgataataagatcaccattcttaacctatcgcttgacataactgaagattgggaagttattttttga

SEQ ID NO: 494 - DNA, 786 bp, Saccharomyces cerevisiae
atgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggataa

SEQ ID NO: 495 - DNA, 2418 bp, Saccharomyces cerevisiae
atgggctcagaacaagccttaagtgaggttgtcgaatctgctaaagagcggttcggcaggcttaggcatttagttcagaagtttcttgatgatgacgacgtgccacaagagtgtctgcctttgctccaagaatgcgcagaaatatggtctagttatgtggacgcatgccaggatataaccatgcaggcccctaaagaagatgcaaaccggttgtcaaaggggtttctccgattgaatgaaacagcttttttatattacatgatcgtatatacgctcttggaggatactctaccaagactaaaggaattttcgagcaacaaggaccagaatgttagaaatttgtacggggagagaatccagcttttgcataatgacccaaatattgagcggattcgaaatgtcattgaaaattaccctaaatttatacagttgcaaactatagagcctggaaaattaagttcaatgttgcattttcatggtgacgctctcttgcttatcgatgtacggcccaggtctgaattcgttagggcccatatcaaatgcaaaaacattatatgcatcgatcctgcctcatttaaggattcttttacagaccaacaaattgaaagtgtctctttgatcacttcgccgcactcagatatcactttcttttcaaatcgagacaagttcaagttcattattttatatactgacactcaattgcataataatttccagcaaaggcaaactcgcatccttgcgaagattctttcccaaaattcagtaattaaaccgctgagtgggacgaaaatactcattttggaaaatgggttctcaaactgggttaaattaggtggggcgtatcaatcatctgtcagtgaaacagcgcatcttacatcctcgtcttcaacgccagcttttggtagtccgcaagtcccaacaggcttgttcaatcagaaatctctatctccaaataaagataagagtatgccgatggtatccatgaatacgcagcctttgctaacaacggtgcaaaggcctcaattacccttatactattcagatttgcccattataccgcaaccaagccccaacagaaattctcccaccgttcaaaaatttagtccacatccaccaaccactctctcaaaactcaatacaccctcgaccattcaaaataaagcaaacactgtggaaagaatatcgccagatatccgcgctgcacaagcccatgcctatttgccccctgcatcgaatgtattctcgccacgtattccgcctttaccacaacagaacttgtcttcgtcgaggcagaccatcctaaacaactcacaagtgcttgatctagatcttatagtaggattggaaaatataggtaactgttgttatatgaactgtatacttcaatgtttggtgggaacacacgatttggttcgaatgtttttggataacacatatctgaattttattaattttgatagttcaagaggttctaaggggttgctagctaaaaatttcgccatcttggtcaataatatgcacagacacggtgcattcacacctcctaacgtaagaacgataccagttcagactattcagtttaaaaaaatttgcggccatatcaaccccatgtatagtgattcaatgcagcaagattgtcaagaattttgtcaatttttgcttgatggcttgcacgaggatttgaaccaaaacggcagcaaaaagcatcttaaacagttatcagatgaggaagaacgaatgagagaaaaaatgtccatacgcaaagctagtgctctcgagtgggaaagatttttgcttaccgacttcagtgcgataattgaccttttccaaggacagtacgcatctaggctacaatgtcaagtttgtgaacatacctccacaacttaccaaacattctctgttctttctgttcctgtcccacgcgttaaaacttgtaacatattagactgtttccgggaattcaccaaatgcgaaaggttaggtgtcgatgaacaatggtcatgtcctaaatgcttaaaaaagcagccttccactaaacaactgaagattactagattgcctaagaaactaattattaatttgaaacgatttgacaatcaaatgaataagaataatgtgtttgtccaatatccttactccttagatcttacaccatattgggcgagagattttaatcatgaagctattgttaatgaggacattcctaccaggggccaagtaccaccatttagatacagactgtatggggttgcatgtcattcggggagtttgtatgggggacactatacttcatacgtttataagggaccaaaaaaaggttggtattttttcgatgactcgctttatcgtcctataacgtttagtactgaatttatcacacccagtgcatatgttttattttacgaaagaattttttga

SEQ ID NO: 496 - DNA, 2295 bp, Saccharomyces cerevisiae
atggtgaacgaattagagaatgtgccacgggcgtcgaccttgacgaatgaagagcaaacggttgatcctagcaataacgactcacaggaagatattagtctgggtgattctaacgaaattacttcgttggcatcattaaaggctatccgatcaggaaatgaagaggaaagcgggaacgagcaggtgaatcataatgatgaggccgaagaagatcctctgttaactcgctaccataccgcttgccaaagaggtgatctagcgactgtcaaagaaatgatacatggaaagttgctcgaagttaataacgacggtgactctacggaacatatcactggtttgcattgggcaagtattaataacagactttctgtagtggattttctagtttcacaaggcgctgatgtcaatgcaagggctggtgctttgcatgccacaccattacattgggctgcaaggtatgggtacgtgtacattgtcgattttttgcttaagcatggagctgatcccaccatgaccgatgaccaaggtttcaatctactacacttatctgtgaacagctcaaatataatgctagttctatacgttttattcaacgttgtcagcaaaggtcttttagatatagattgccgagacccaaagggcagaacttcactactatgggctgcttaccagggagattccctaactgtagcagaattgttgaaatttggtgccagcataaagatcgcagatacagaaggattcaccccactgcactggggcactgtaaaagggcaaccacatgtactaaaatacttgattcaagatggtgcagattttttccaaaaaacggataccggaaaagattgctttgctattgctcaagaaatgaacactgtgtactcacttagagaggctctaacacattctggattcgactaccatggttatcccattaaaaaatggttcaaaaaaagtcaacatgctaagctcgttacattcataacgccatttctatttctaggaatcgcatttgctcttttctctcatattaaccctttgtttgtaatcattgtcctttttttattggccattgccactaacaaaggcttgaacaaattcgttctgccgtcatatggacgaatgggtgtccacaacgttaccttgttaaggtcacctttgttatccggtgttttttttggcactttactttgggtgactatcgtttggtttttcaaagttatgcctcgaacattttctgatgaacaatatactaacatcctaatgctggtaatacttgtttctgtattttacctttttgggcagcttgttattatggacccaggatgtttgccagaagaaactgatcatgagaacgtgcgacaaacaatctcgaacttgctcgaaatcggtaaatttgatacgaagaacttttgtatcgaaacttggattagaaaacctctaagaagcaaattttcgcccttaaacaatgctgtggttgcaagatttgatcattactgcccttggatctttaatgatgtcggactcaaaaatcacaaagcatttatattttttattacattaatggaaagtggtattttcacatttcttgcactttgcctggaatattttgatgaacttgaagatgcacacgaagatacatcccagaaaaatggcaaatgtttcatcctaggcgcttcagatctctgttcgggattaatatatgatagatttgtctttctgatattattatgggctttactccaatctatttgggttgcaagtttgatcttcgtccaagcctttcaaatatgtaaaggaatgaccaatacagaattcaatgttttgatgaaagagagtaagtccattggccccgatgggttatctttcaatgaaaacttcaatactactccagaaggatttgcgccgtcgattgatccgggtgaggagagtaatgatactgtactagcaccagtcccaggctcaacgataaggaaaccacgcacttgttttggcgtttgttacgcggtgactggtatggatcagtggttagcggttataaaagaaaccattggcatcaaggatagcaccggacataatgtgtattcgattacatcaagaataccaacaaattacggttggaaaagaaatgttaaagacttttggcttacaagcgatataaatgcgcctttgtggaggcgaattttgtatcctccttcgggctctaaagctttgctcaacgggatagaagttgactattttaagctttacaaattgccaaataaggatgttgaacaaggaaatgatatggtatga

SEQ ID NO: 497 - DNA, 2013 bp, Saccharomyces cerevisiae
atggtagaaccggacatgcagaagaaggcaagtggtggcagtggcggttccgagatggatactttaaatgctaccagcaacagtagtaaacaaggagtttcaaataataaaaggaatccggtcagtaaaaagaaaccagggaataaggtctctgatggaagagataatgcacataattatcacggggaaggccgcagaaaaagtagcaaacaacagaggtcaagaacgccctataaggagactagtactaggatcaatgatcaagatatagatttatctatccaggaagaaattcttggtggtaatttcaaattacgaggcaggaaaactcaagtttccattaatcatttgttgaatttccagttacctgaagtcgaaagggaaaaaagtaggtcctcttcaagtaagaaatcgaataggagacgcgatgagcacgtacatttacacggtgacacatttgttaatgttaattaccgtcttttggtagatgatcgttttgactacccagagcaaaactgtaacccgaacgttcctgtcgatcaagaaaagattctaagagtcatagtgccaaagggtcagaattgttctatttgtctgagcgaggaaccggtggctcccagaatggttacttgtggccatattttctgtctaagttgtctcttgaactttttctccattgaagaaaccgtcaaaaataaagagactgggtactcaaagaagaagaaatataaagaatgcccgctttgtggaagtattattggccctaaaagggtcaagcctgttctgtatgaggacgactttgatgtaaccaggttaaatcaaaaacccgaacctggtgccacagtacatctacaactgatgtgtaaaccacacggttcactattacctttgccagtagccttacatttagaccctctaaaatgtggaaatttccctcccgcaaacttaggatcaataaagcattatgcgcatattatgaagtgtggcgtgtcttactccttggagctctatcaaaaggacattgttgctattcaggaacaatatgaaatcgacaaggccatttataatgatagtggaaaatttgttaagcagtcgattgaaaatatcaatgatcaaatttcgacgttgctggctgcaaccactgatttgagcccactttccaacgatattaacaacggtttggacaattttcattttgatgacgatctcttgaccaaatacgatgattcttccgcttattttttctaccagacgttggtggcatcgtccacgaaatacttcttatctccactggatgtaaaaatcttattgactattttccactattattccaagtttccagaaagcatcgagacgacagtcgaaaatatacattatgatacagtggtaacggagcaattaatccgccgctacaagtacatcggccaccttccaatcggcactgagattgcccttttagacttggactggcgtaaaataccattccttcccaaggaaatttacgaacagtttgctcatgagctaaaacaacgtcgaagaaaattcacaatgaaaaagcaaaaggaagataaggaaaagaaactatatgaaaaaaggttggaacaagaacatgccgagttctacagaaaggaaaatggcaattctctcaagtttgaagactctgtacagatggctacccattatgaatccattgtaagctcttccatacctctcaactccttaggaatttctatgctgggtccaccgacaaattcctgctctactcctcaaaagcaagcgccctcccacacgaaaagaacaatttgggggacatcaattgcagtgacggaagacgaaaaagcatcaaaggagaacaaagaatttcaagatatgttattgcagcgaataaggcaggaagatagttcggatgtcacagattcgacggattctcctcctacaagtaatggtaagcgaggcaggaagaagaaaggtaaagtcatgctattcagcagcaatcatcaagccttgggttag

SEQ ID NO: 498 - DNA, 390 bp, Saccharomyces cerevisiae
atgttcatattaggcagtgtcggatgtgtcgaggcggacgaagcctcgccattatattgtctctcggctgccttgataaggttgtcaaatgacgagatgggaggcaacgtgatgtggttcatagcactattgtttgcattactcatcgctcgctgcacatgccacacaaaaaacacccaccctgatttctcgaaaccaactttttgtcaccaacatgcagcgcttaccaacagtctgtcttctttataccgttgctttgttccagatggtactgccatgcttccaacggctacaaaaaaaacaccgcaacggcgaaaaaatggcgcaattattcaccgtgtagtcatttaccacggccgggaaagcgcgaatgggatcagcaaacaataa

SEQ ID NO: 499 - DNA, 1848 bp, Saccharomyces cerevisiae
atgtcatctatctctttgaaggaaattataccacctcagccttcgacacagcgtaactttactacgcatttatcgtatgaccctacaaccaacgcaattgcttacccatgtggaaaatctgcatttgtacgttgtttggacgatggagacagtaaagtacctccagtagtacaatttactggtcatggctcttcggtagtcacaacggtaaagttctctccaattaagggttcccagtacctatgctccggtgacgaatctggaaaagtgattgtttggggatggacatttgacaaagaaagcaattctgttgaagtgaatgttaagtctgaattccaagttttagcaggtccaatcagcgatatctcctgggattttgaagggcgaagactctgcgttgtgggagaaggtcgtgataactttggtgttttcatatcctgggattctggtaattccttaggtgaagtttcaggtcactcacaacgcatcaatgcttgtcatttgaagcaatctagacctatgagatctatgacagttggagatgatggatctgttgtcttttatcaaggacctccatttaagttctctgccagtgacagaacacaccacaaacaaggctcatttgtcagggatgttgaattttcacctgacagcggtgaatttgttattacggtagggtctgacagaaagatttcttgctttgatggcaaatcaggtgagtttcttaaatacatagaggatgatcaagaaccagttcaaggtggtatatttgcactatcgtggcttgattcccaaaagtttgctaccgtaggagcagacgctaccattagggtttgggacgtcacgacttcaaaatgcgttcaaaaatggaccttagacaagcaacaactgggaaatcaacaagttggtgttgttgcaacaggaaacggaaggattatttctctttcactggatgggaccttaaacttctatgaacttggacatgacgaggttttaaaaaccattagtggtcataacaagggtattactgctttgacagtcaacccactaatcagtgggtcatatgatggtaggattatggaatggtctagctcttccatgcaccaagatcactccaacttgattgtatcattggataatagtaaagcgcaagaatactccagtatttcttgggatgatactttgaaagtgaacggtattactaagcatgaatttggatcgcaaccaaaggttgctagtgcgaacaatgatggcttcactgcagtactaacaaatgatgatgatttgttgatattacagtcttttacgggcgatataatcaagagtgtaagactgaactcaccaggctctgccgttagcttgagccaaaattacgttgcagttggtttggaagaaggtaatactattcaggtattcaaattatcagatttggaagtcagttttgatttaaaaacacctcttcgcgcaaaaccctcgtacatatcaatttcgccatctgaaacatacatcgctgctggagatgttatgggcaagatattgctatatgatttacaatcaagagaagtgaaaacttcaagatgggctttccacaccagtaaaatcaacgccatttcatggaaacctgctgaaaagggagcaaacgaagaggaaattgaagaggacttagttgccactggttctttagacaccaatatttttatttactccgtcaaaagacctatgaaaatcattaaggcgttgaatgctcacaaggacggtgttaacaaccttttatgggaaacaccatctaccttggttagttctggtgcggacgcttgcattaaaaggtggaatgttgtcctcgagtga

SEQ ID NO: 500 - DNA, 1770 bp, Saccharomyces cerevisiae
atgagtggagtatcaaataaaacagtatcaattaatggttggtatggcatgccaattcatttactaagggaagaaggcgactttgcccagtttatgattctaaccatcaacgaattaaaaatagccatacatggttacctcagaaataccccatggtacaacatgttgaaggattatttgtttgtgatcttttgttacaagctaataagtaattttttttatctgttgaaagtttatgggccggtgaggttagcagtgagaacatacgagcatagttccagaagattgtttcgttggttattggactcaccatttttgaggggtaccgtagaaaaggaagtcacaaaggtcaaacaatcgatcgaagacgaactaattagatcggactctcagttaatgaatttcccacagttgccatccaatgggatacctcaggatgatgttattgaagagctaaataaattgaacgacttgataccacatacccaatggaaggaaggaaaggtctctggtgccgtttaccacggtggtgatgatttgatccacttacaaacaatcgcatacgaaaaatattgcgttgccaatcaattacatcccgatgtctttcctgccgtacgtaaaatggaatccgaagtggtttctatggttttaagaatgtttaatgccccttctgatacaggttgtggtaccacaacttcaggtggtacagaatccttgcttttagcatgtctgagcgctaaaatgtatgcccttcatcatcgtggaatcaccgaaccagaaataattgctcccgtaactgcacatgctgggtttgacaaagctgcttattactttggcatgaagctacgccacgtggagctagatccaacgacatatcaagtggacctgggaaaagtgaaaaaattcatcaataagaacacaattttactggtcggttccgctccaaactttcctcatggtattgccgatgatattgaaggattgggtaaaatagcacaaaaatataaacttcctttacacgtcgacagttgtctaggttcctttattgtttcatttatggaaaaggctggttacaaaaatctgccattacttgactttagagtcccgggagtcacctcaatatcatgtgacactcataaatatggatttgcaccaaaaggctcgtcagttataatgtatagaaacagcgacttacgaatgcatcagtattacgtaaatcctgcttggactggcgggttatatggctctcctacattagcagggtccaggcctggtgctattgtcgtaggttgttgggccactatggtcaacatgggtgaaaatgggtacattgagtcgtgccaagaaatagtcggtgcagcaatgaagtttaaaaaatacatccaggaaaacattccagacctgaatataatgggcaaccctagatattcagtcatttcattttcttcaaagaccttgaacatacacgaactatctgacaggttgtccaagaaaggctggcatttcaatgccctacaaaagccggttgcactacacatggccttcacgagattgagcgctcatgttgtggatgagatctgcgacattttacgtactaccgtgcaagagttgaagagcgaatcaaattctaaaccatccccagacggaactagcgctctatatggtgtcgccgggagcgttaaaactgctggcgttgcagacaaattgattgtgggattcctagacgcattatacaagttgggtccaggagaggataccgccaccaagtag

SEQ ID NO: 501 - DNA, 1677 bp, Saccharomyces cerevisiae
atggcacacatcccagaggttttacccaaatcaataccgattccggcatttattgttaccacctcatcgtacctatggtactacttcaatctggtgttgactcaaatcccgggaggccaattcatcgtttcgtacatcaagaaatcgcatcatgacgatccatacaggaccacggttgagatagggcttattttatacgggatcatctattacttgtccaagccacaacagaaaaagagtcttcaagcacagaagcccaacctatcgccccaggagattgacgcgctaattgaggactgggagcccgagcctctagtcgacccttctgccaccgatgagcaatcgtggagggtggccaaaacacccgtcaccatggaaatgcccattcagaaccatattactatcaccagaaacaacctgcaggagaagtataccaatgttttcaatttggcctcgaacaactttttgcaattgtccgctacggagcccgtgaaagaagtggtcaagaccactatcaagaattacggtgtgggcgcctgtggtcccgccgggttctacggtaaccaggacgttcattacacgttggaatatgatttagcacagttctttggcacccaaggttccgttctgtacgggcaagacttttgtgccgcaccctctgttctgcctgctttcacaaagcgtggtgatgttatcgtggcagacgaccaggtgtcattaccagtgcaaaatgctctgcaactaagcagatccacagtctactacttcaaccacaacgatatgaattcgctagaatgtttattaaacgagttgaccgaacaggagaaacttgagaaactgcccgccattccaagaaaatttatcgtcactgagggtattttccacaactcgggcgatttagctccgttgcctgagttgactaagctgaagaacaagtacaagttcagactatttgttgacgaaaccttctccattggtgttcttggcgctacgggccgtgggttgtcagagcacttcaacatggatcgcgcaactgccattgacattaccgttgggtccatggccaccgcgttggggtccaccggtggttttgtcctgggtgacagtgttatgtgtttgcaccagcgtattggttccaatgcatattgtttttctgcctgtttgccggcttacaccgtcacatccgtctccaaagtcttgaaattgatggactccaacaacgacgccgtccagacgctgcaaaaactatccaaatctttgcatgattcctttgcatctgacgactccttgcgttcatacgtaatcgtcacgtcctctccagtgtctgctgtcctacatctgcaactgactcccgcatataggtctcgcaagttcggatacacctgcgaacagctattcgaaaccatgtcagctttgcaaaagaagtcccagacaaacaaattcattgagccatacgaagaggaggaaaaatttctgcagtccatagtagatcatgctcttattaactacaacgttctcatcacaagaaacactattgttttaaaacaggagacgctaccaattgtccctagcttgaaaatctgctgtaacgccgccatgtccccagaggaactcaaaaatgcttgcgaaagtgtcaagcagtccatccttgcctgttgccaagaatctaataaataa

SEQ ID NO: 502 - DNA, 1809 bp, Saccharomyces cerevisiae
atgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaa

SEQ ID NO: 503 - DNA, 2592 bp, Saccharomyces cerevisiae
atggtagatatatccgatacaagtggatacctacataaacaaggtgtcttacctagtgtttctttcatttgcacttctttttttgcgtgtggactgacatcttggaaagttgaactgtcatattatatagttgttgcagccgccatgggaaacagtccttctactcaggatccatcgcattcaaccaaaaaggagcatggacatcattttcatgatgcattcaataaagatcgtcagggaagcataacctctcaactgtttaacaataggaagagtactcataagagacgcgccagtcatactagcgaacataatggtgccattccccctagaatgcaattacttgcatctcacgatccatcgacagattgtgatgggcgcatgagcagtgatactactatcgataagggcccgtcccatctattcaaaaaggattattctttgtcctctgccgcagacgtaaatgacactacgttggccaatttgactttaagtgatgatcacgatgtgggtgcacccgaagagcaggtgaaatctccgtcgtttttgagcccaggtccatcaatggccactgtcaaacgaactaaaagtgatctggatgatctgtctactttgaattacaccatggttgacgaaacaacagaaaatgaaagaaacgacaaaccacaccatgaaaggcatcgctcaagcatcatagctttgaaaaaaaatcttttagaaagttcagctactgcttccccttctccaacgaggtcttcatcggtgcattcagcatcacttcccgccttgaccaagacggattccattgatattcctgtaagacaaccctattcaaagaaaccatctatccatgcataccaatatcaatatctcaataacgacgaaacattttctgagaactctcaaatggataaagagggaaacagtgatagtgtagatgcagaagcaggcgtacttcaaagtgaagatatggttttgaaccagtctcttttacaaaatgctttaaaaaaggatatgcaacgtctttcaagggtgaattcctctaattcaatgtatactgcagaaaggataagccacgctaataacaatggaaatattgaaaataacacccgtaacaagggaaacgcgggaggctccaacgacgattttaccgcacctatatctgctactgcaaaaatgatgatgaaactgtacggtgataagaccttgatggaaagagatttaaataagcaccataataagacaaagaaagcccagaataaaaaaataaggtcggtttcaaattcgagaagatcctcatttgcttctttgcattctttacaatcaagaaagagtatcttaacaaacggtttgaatttgcagcctttgcatccactacatccaattattaacgacaatgaaagtcaatactctgcaccgcagcatagagaaatatcgcatcactctaattccatgtcgagtatgtcttcaatatcatcaacaaactccaccgaaaatactttagttgttctaaaatggaaagacgatggtaccgtggctgcaaccacggaagtctttatagtaagcacggatattgcttctgctcttaaagagcaaagagagcttaccttggatgagaatgcaagtttagactcagaaaaacagttaaatcctaggatccgcatggtttatgatgatgtgcataaggaatggtttgttccagatctttttttgcctgcaggaatttatagactgcaattctccatcaatggtatattgactcactcaaattttcttcctacagctacggattcagaaggcaattttgtcaactggtttgaagtattgcccggttatcatacgatcgagccatttagaaacgaagcagacatcgactcgcaagtagagccaacactggatgaagaattgcccaagagaccggaacttaaaagatttccttcttcctctcgaaaatcttcctactattctgctaagggtgttgaaaggccaagtacaccgttttcagattatagaggcttaagtaggtccagttcaataaatatgcgtgactcatttgtacgtctgaaggctagcagtttggatttgatggccgaggtcaagcctgagaggttggtgtattcgaacgaaataccaaatttatttaatataggtgacggctctacgatttctgtaaaaggagattctgatgacgtgcatccccaagaacctcccagctttacacatagagttgttgactgtaatcaagatgatttatttgctactttacagcaaggcggtaatattgatgcagaaacagcagaggcggtttttctaagtagatacccagttcctgacttgcccatatacctgaattcatcctatctgaacagaatactaaaccaaagcaatcagaattcagaatcacatgagagggatgaaggtgcgataaatcatattataccccacgtgaatttgaaccatttactgacaagcagtattagagatgaaataatcagcgtagcttgcactactagatatgaggggaaatttatcactcaagtagtttatgcaccttgttattataaaacacaaaagtctcagatcagtaattag

SEQ ID NO: 504 - DNA, 2916 bp, Saccharomyces cerevisiae
atggtcggttccggttctcacactccttatgatatatcaaactctccatctgatgtaaatgtccaacccgcaacacaactaaattccaccttggtggaggatgacgatgtagataatcagctatttgaagaggctcaagtcactgagactggattccgttcgccttcagcttcagacaattcatgtgcgtattgtggtatagattctgcaaagtgtgtcatcaaatgtaattcatgtaagaaatggttttgtaacactaaaaacggtacaagcagctcccacattgttaatcacttagttttatcccaccataacgtagtttctttacatccagattctgacttaggggataccgttttggaatgttataactgtggacgtaagaacgtgtttttattgggatttgtttccgctaaaagtgaggccgtggttgttttactttgtagaataccttgtgcccagacgaaaaatgcgaactgggatactgatcaatggcaaccattaattgaagacagacaacttttatcatgggtcgcagagcaaccaactgaagaagaaaaattgaaagctcgtttaatcactcctagccaaatttccaagttggaggcaaaatggagatccaataaagacgctacaattaatgatattgacgccccagaggaacaggaagcaatcccacctttactattgagatatcaagacgcctacgaataccaaagatcttacgggcctttaatcaaattggaggccgactatgataaacaactcaaggaatctcaagctttagaacatatttctgtttcatggtccttagctttaaataataggcatttagcatctttcactttatctactttcgaatctaacgagttgaaagttgccatcggtgatgaaatgatactatggtactctggcatgcaacatcctgattgggaaggtcgtggttacattgttcggttaccaaatagcttccaggacacattcacattagagttaaaaccaagtaaaacgccacctccaacacatttgaccactggttttactgctgagttcatctggaaaggtacctcttatgacaggatgcaagacgcattgaaaaaatttgccattgataaaaaatctatttcaggttatttgtactataaaattttaggccatcaagtggttgacatttcatttgatgtcccattacctaaggagttttcaattccgaattttgcacaattaaactcatcccagtcgaacgctgttagtcatgtattacaacgtccgttatctttaattcaaggcccaccaggcactggtaaaacagttacttcagcaacgattgtgtatcacctttccaaaatacacaaggatagaatattggtgtgtgccccatcaaacgttgctgtagatcatttggctgccaaattacgtgacttgggtttaaaagttgttagacttaccgcgaaaagtagagaagatgtggagagttccgtctccaacttagcattgcataatttggttggccgtggtgctaaaggggaattaaaaaacctattaaagttaaaggatgaagttggcgaattatctgcttctgatacaaaacggtttgttaaattagtaaggaaaacagaagcagaaattctcaataaggcagatgtcgtatgttgcacatgtgttggtgctggtgataagcgcttagacactaaatttaggactgtgttaattgatgaaagtactcaagcttctgagccggaatgtttaatcccaatcgttaaaggtgcgaaacaagttatacttgttggtgatcaccagcaactgggcccagtcatattggaacgaaaggcggcagacgctggtttgaaacaatctctctttgaaagattaatctctctaggccacgtaccgattcgtttggaagttcaataccgtatgaatccttatttgagtgagtttccaagtaacatgttttatgaaggcagcctacaaaatggtgtaacgattgaacagcgtaccgttcccaacagcaaattcccatggccaattcgcggtataccaatgatgttttgggccaattacggtagagaggagatttctgctaacggtacttccttcttaaacagaattgaagccatgaattgtgaacgaatcatcactaaacttttcagagacggtgtcaagcccgagcaaattggtgttatcacaccatatgagggacaaagagcttatattttacaatatatgcaaatgaatggttcattggataaggatttgtatatcaaagtggaagttgcctcagttgatgcattccaaggtcgtgaaaaggattacataatcttatcgtgtgttcgtgccaatgaacaacaggccattggtttcttacgtgatcctcgtcgtctaaacgtgggtctaacccgtgccaaatatggtctagttattcttggtaatcctagatctttggcaagaaacacattatggaaccatctgttaatccacttcagagagaagggttgtttagtcgaaggtacgttggataacttacagttatgcactgttcaattagttcgtcctcagccaagaaagactgaacggccaatgaacgctcaatttaacgtagaatctgaaatgggtgactttccgaagttccaggattttgatgcacagagtatggtgtcattcagtggtcaaattggggactttggtaatgcatttgttgacaacacagaactttcttcttacatcaataatgaatattggaattttgagaattttaaaagtgctttttctcaaaagcaaaatcgcaatgaaattgacgatagaaatttgtaccaggaggaggcttctcatttgaactctaacttcgcgagagagttacagagagaagaacaaaagcatgaattgtcaaaagacttcagcaatttgggaatataa

SEQ ID NO: 505 - DNA, 3033 bp, Saccharomyces cerevisiae
atgtttaagaaaagcaggcatttgaagaatgtgtcaaatgctatcaaatccgcgagagttcatgacgtctcaaatggtattaactccaaatttttcgatactaagaaaatatgcacatacggcataaatggacgaatcactgttaccacattcgactatactcaaagccttttggcagttgcaactactgctggggagatacatgtttatgggcaaaagcaaatagaggtcgtatttacgttaaaaaatcgacctcaaattaaacacatgcggtttattaaaggaatttatctgatagctgtagatgagaagagcaacataatagtcctttcagtacactcgaaacagattctaactactgttttctgtccaaacagcatcacttgttttgagactgatccgcccttggattggatgctgattggcctcgagagtggatccatattgatctatgatgtggatagaaatcaaatgtccaaattgaaaattgaaaacttccagaaaagtgtgtttttgccaaaagagaggctatcaccggttatttctatccaatggaatcctagagacataggaacgatacttatatcatatgagcatattacagtcatatattctttcattgactacaaagtcaagcaacattttttttaccaattagaaccgtatgctccgggcggtgatctatccacaaacatagaaaagaaacgcactccaaaggtcattcagtcactttatcacccaaattccttacatatattaactgtccatgaagataatgccttggtattttgggatgtcaatagcggtaaactgattcacgctagaagtatatttgaaacacatgtgaattttccaaatcctgccttgaaagactgttcctttacagaaacacccgctatctttaaagtaagctggctttgccagcgtaatcctgagtatacatcgttgttgattgcaacaaaagctacagaaaatccctgtttacctcaggaaataaccatgattgacttaggcggcacaccaatgtattctgtgacatcatttgacgcaatgagcaagtactatgctaaaccggttcaacaaaaactattttcgttgattggcaaagctccactaataaattttctacccttgccgaaggcttctccatattttggtggatgccatgacacaaacctcattttattacttttagaagatggcgaacttgaaacattgatatacccagcaggctcttttagttccaaggcctccattttccctcggagcttagcatgggttcgaccaacggttactacttgtatagcgcaatcagttcaaaaaaatctttggctggggatgatgacaatcgctcaaagtgaatcgtttttaaaaggtggtattcctgccaccagaaatattagaaggcatgagaccagatctgctttactaactgggcatagtaatggttcagtcagaatatgggatgcttcacacagtgaagtaactgacaacgctgtatttgaagtgaatactgctaaagtacttaacagagctactaacctggccataaaaaatatctcctttgcatcggaaacattggaattggcggtatcatctgaggttggggatgttattcttttcaaattcgaaacaaacaagttttacggacaacttcccaaaagcgatgcactgcaattgaagtttagcagattttcattggatgattcaaaaactattttagttgatgtttcggatagagggcctacgaacgttaaacaaggctttataccaagtacggtaatacatgctaaaaaaggtgcggtgtccgcaatcatgaatagtaatatcgggttcgttgccgttggtttcattgaaggaaccttaataatattggacagaagaggcccggctataatcttcaatgaaaatattagggtcatttctaaagctggtagctcttacgtttcaaccgttcacttttgcgtcatggaatatggagatgatgggttctctagtattttgatgctatgtggaacggatatcggggaattgatgactttcaaaatactgcctgcaactaatggaagatttgaggttaaattcactgatgcaacaaagaccaacaatcaaggaaaaattctaggaataaattcttttgccaaagatactggctacagttgttctgctactatatcaaagatgcagggtttaagcaagggtatcgcaatacctggatttgttactatcagtggcgcaaatgacattcgtttagtatcaccaggtaaatctaaggacactcatgcgcttttcaagtatccaattgccactagtggattatcatttattcccattattgacggtaaaggagaaagaaagctttcaactattatgatcgttttgctaattaatggagatattaaagttttgacagtacctgagcttaaggaagtcaaaaatctacgctgcccggtccctctaagcgctcaatacgttgaaaattcatctatattagaaaatgttgacattgtcattcgcacagggaaattccaagcttctttgatttcagtacttaatgaaagtgccaccggttcgaatcatactgctgacatatcacaacatactcctattgataccttgtacaatcctgatttaaagattggttataggcctcaagtgaattccttacaatgggctagaggaactatttattgcacaccatatcaacttgatgagctactgggcggtatagaaaggcccgaatcgaagtatgaggaaagcgcaattgctcgaggatgcatatcttccagtagtagtaatgcagccagaaagttacctcccggtacgaaagatcacaggtatgccagacctgtaagaagctctggaagaagtaatggatatggtgtccttaaaagtgtttctagggcaattgaaactcgtttagacacggtagaaaccactattaatgactatgcaaccacaatgggacaaaccatgaatgacgcaatggaagaaacgggaagggatatgatgaagagcgctgtaggtttttag

SEQ ID NO: 506 - DNA, 2871 bp, Saccharomyces cerevisiae
atgccagtctctgtaataaccacggttttagcatgtctgtggctctcttataggctctataagtttctcactattcctgtgtccagcatcgtctccactttgaagatcaaaactccaccggcaacaaaagtgtctatcgacaaaatagccacggattcagtgaccattcattgggagaacgaacctgtaaaagcggaggacaatggcagtgcggatagaaacttcatttcccactatttgttgtatctgaataacacacaattggctatcttcccaaacaacccaaactccctttacacatgctgctccatcacgggtctcgaggcggagacgcagtaccagttagattttataacgattaacaacaagggctttatcaataagctaccctccatttactgtatgacgaaggcgagagaggcgaatgaagcgttaaagactagaaaatggagaagaaacaccatcacatcgtccacagctatgcagcccagaaactccaagtccgaacccgccccgttgccctctcactactcctctgtttccctgtctactttctcatccaatattactaatagcgccaccagcaataatggttcaaatctacccgcttacacatctttgactacgttgaaggatttggattcgttttccatcgatgatctgaaaaagatactgatttgcgcccaggaggacttacacgatgtgttgtcccaacaaacttcgcttttgcaagattttcaagaatcgaagttagaattagaactagaactggataacttgaaaacacattggtcgcacgaaattgacttgcggaaatccttgaaatccaatatcaagtcattggagaattctaaactattgaccgatttgaaaatcgaaaaattgaacaagaaaatcgacaaatccaaggaaaaaatatcgaaaatgcgcaatgatatgcagaaatggtctcaggaagataccgagctgttgtctaaggataccataaaggagaaatatttcaaattgctaaatgaatccaatgcctctgtggccaatatcaacaaagaaattgagtctttacaaaatgaaatttccaagatggaggagtctaacaagagattgaacgcctccaaaaaatcattgattacttccatagtggtgaatgccaatgtggaaaacgataaacctattgctagcggagaattgtcggctgttttgaagaagctcaatgattttactttagaaaaaaatggatttttaagtaatgctggtgaagagtttctatccaaattgaatgcagactcatcattgattaaaatgattaagcaagagctaagcattgatcaagaattggaggccaactggaaattgcagaggtcaaatttgttgaagaaaattagtgctttagaaaaccaatttaatgaaatgagccttaataatcggaatttgaaaacaaaattaatggttcaaccatataagaataacggtgattcgcttgctgccaccaattcgaataattccgcggaaaaaaacagaagttctggatcgattcaattaccattatccaacaacatgtcaagaacggggtccattgatttaatatcgaataataacaaaagtattaacaacagtaatgctgattctgctcctccgttgaggttgcacaatccagtttcgtactctccttcgaatgaacccatacaaccttcaagcagtctattgagtcaattgacacaggacaccgataatcgatcaatgctctccaatcacatctcatcgaacaacgaaaacaagcaacagccttcttcatattcacatgctttacctacaactgctactgctaatgcaacagcaacagcaacagcaactaatggtcactcaaggtcaaatttatggaccaccgcacaattcgctcaaccttcgcatcaacaagtatctacagaattggatcaagcttttgaatacgataatgcaaaccacttaatcagtggtttgcaaaatatgatctacgacgaaacagactatcctgataacataagcaattattccaagggttttactacagacgaacttgacaattactggactaagcagcaaccccaggtgcgcagcacaaatgaaagtcttttctctacgactggaacacctatgtcatcatataaggctaacccagtaatatctccatattctagttctcatttgcgacaaacctccaacgcaaccaatacgaatcctatgcatccacagagtctactcgccgctacattgaatgatccttcattacaaagttttgtacgcagtggttctttctacagtgctccgcaacctgcaaactccttacagaacaatatcaatggcaatgaaaccgagaacattagtccaaggatatcaagtgacttcaatttattggtgccaaacttgagcccacgactctcaaacgatgtgcccattgttccaggcaataacactactttaacaccttcacactcgaacatattaacaatgaaccatcaaccaacggcggataacattacacgaagatctttccatgcctcttcaccacctttcaactccatatggaattcaaatacaaatcaactttctcctccattggaggagcagtatcacctcgatgtgcctgtgggtccaaaggttcccgctaaagaaccaagccctaagccttctcacaagaggaaccaaagtaacagcagcatttcttctgcatggtccaagtttaagcacaagtctgcatcatcacctgctaatgcggacacggatattcaagattcatcaactccatcaactagtccaagcggtagaagaatgtcaaaactgttgtccaagagcggtatgaataatctatttaacccgcacagtcacgactcatga

SEQ ID NO: 507 - DNA, 1632 bp, Saccharomyces cerevisiae
atgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtag

SEQ ID NO: 508 - DNA, 1383 bp, Saccharomyces cerevisiae
atgcctagggccttatcaataaaatttgacaatacgtatatggacctttacgatgaattaccggaaagtaaactcctttatgatgaagaattttcatatcttttggatgcagtaaggcaaaatggtgtctgcgtcgtagattttttaacactcactccgaaggaattggcaaggctaatacaaaggtcgataaatgaggttttcagatttcagcaattgcttgttcatgaatataatgaaaagtacttagaaatctgtgaaaaaaactctatcagcccagataacggtcctgagtgtttcacgactgctgatgtagctatggatgaattattaggtggaggcatattcacgcatggcattacagaaatattcggagagagctctactggtaaatctcaattacttatgcagttggcgttaagtgtccaactttccgaacctgcgggagggcttggcggcaaatgtgtatatattaccactgagggcgatttaccaactcagagattggaaagtatgctatcgtctaggccggcttatgaaaaactaggtattacacaatcaaatattttcaccgtcagctgtaacgacctaataaatcaggaacacataatcaatgttcagttgcctattttattagagagatctaagggttcaataaaattggtgataatagattcgatttctcatcatttgagggtggagcttcagaacaagtccttcagagaatcccaagaaaataaaaactatctggataggatggcagagaagctccaaatactggcccacgattattcattatccgttgtggtggctaatcaagttggggataaaccactggctaacagtccagtggcacataggacatatgtaactgattatgattatcagctagggtggctagttggctggaagaactcaaccattctttatcggcagatgaattcgctgcttggagcaagttccaataacgatgaaattctatcagacgatgaagattatatgctaatcgagagagttatgagcactgtaaatgaccggaattatgattttttttcaaaaaagaaaccacccataattgagaataaaaccgttgagcgaaattcatcaagtcctatcagtcgacaaagtaagaaacggaaatttgactatcgtgtccccaatctcggtttgacttggtccaatcacgtttcaacacgaatattacttcaaaaatctttcaaggcttcaacaataattcaaagaggtgaagctcatctttataagggaggtgattcggcaagcttctggcaagttaagaggacaatgaaagtggtatattccacattcgctaagcctggtcaaattgcatatcaaattactaagcgaggaatagaaacagcctga

SEQ ID NO: 509 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgttccatctggtgcctccaccggtgtccacgaagctttggaaatgagagatgaagacaaatccaagtggatgggtaagggtgttatgaacgctgtcaacaacgtcaacaacgtcattgctgctgctttcgtcaaggccaacctagatgttaaggaccaaaaggccgtcgatgacttcttgttgtctttggatggtaccgccaacaagtccaagttgggtgctaacgctatcttgggtgtctccatggccgctgctagagccgctgctgctgaaaagaacgtcccattgtaccaacatttggctgacttgtctaagtccaagacctctccatacgttttgccagttccattcttgaacgttttgaacggtggttcccacgctggtggtgctttggctttgcaagaattcatgattgctccaactggtgctaagaccttcgctgaagccatgagaattggttccgaagtttaccacaacttgaagtctttgaccaagaagagatacggtgcttctgccggtaacgtcggtgacgaaggtggtgttgctccaaacattcaaaccgctgaagaagctttggacttgattgttgacgctatcaaggctgctggtcacgacggtaaggtcaagatcggtttggactgtgcttcctctgaattcttcaaggacggtaagtacgacttggacttcaagaacccagaatctgacaaatccaagtggttgactggtgtcgaattagctgacatgtaccactccttgatgaagagatacccaattgtctccatcgaagatccatttgctgaagatgactgggaagcttggtctcacttcttcaagaccgctggtatccaaattgttgctgatgacttgactgtcaccaacccagctagaattgctaccgccatcgaaaagaaggctgctgacgctttgttgttgaaggttaaccaaatcggtaccttgtctgaatccatcaaggctgctcaagactctttcgctgccaactggggtgttatggtttcccacagatctggtgaaactgaagacactttcattgctgacttggttgtcggtttgagaactggtcaaatcaagactggtgctccagctagatccgaaagattggctaagttgaaccaattgttgagaatcgaagaagaattgggtgacaaggctgtctacgccggtgaaaacttccaccacggtgacaagttgtaa

SEQ ID NO: 510 - DNA, 1350 bp, Saccharomyces cerevisiae
atgtctgctccagctcaaaactacaaaatcgctgatatctctttggctgccttcggtagaaaggaaatcgaattggctgaacatgaaatgccaggtttgatggccatcagaaaggcttacggtgacgtccaacctttgaaaggcgcccgtattgctggttgtttgcacatgaccattcaaactgctgttttaattgaaactttagttgctttgggtgccgaagttacctggtcctcttgtaacatctattcgactcaagatcatgccgccgctgctattgccgcttccggtgttccagtttttgcctggaagggtgaaactgaagaagagtatttgtggtgtattgaacaacaattgtttgccttcaaggacaacaagaaattgaacttgatcttagatgatggtggtgatttaaccactttagttcatgaaaagcaccctgaaatgctggaagactgctttggtctttccgaagaaactaccaccggtgttcaccacttatacagaatggtcaaagaaggcaagttaaaggttcctgccattaacgttaacgactccgtcactaagtccaagtttgacaacttgtacggctgtagagaatccttagtcgacggtattaagagagccactgatgtcatgttggctggtaaggttgccgttgttgctggttacggtgatgtcggtaagggttgtgctgctgccttaagaggaatgggtgctcgtgtcttggttaccgaaattgacccaatcaacgctttacaagctgccatggaaggctaccaagttgttaccatggaagatgcatcccacattggtcaagttttcgttaccaccactggttgtagagatattatcaacggtgaacatttcatcaacatgccagaagatgccattgtttgtaacattggccatttcgatatcgaaattgatgtcgcctggttaaaggctaacgctaaagaatgtattaacatcaaaccacaagtcgaccgttacttgttgtcttctggtagacacgtcatcttgttggctaacggtagattagttaacttgggttgtgctactggtcactcatctttcgttatgtcttgttccttctctaaccaagtcttagctcaaattgctttgttcaagtctaacgataagtctttcagagaaaagcacattgaattccaaaagacaggcccattcgaagttggtgtccacgttttgccaaagatcttggatgaagctgtcgctaagttccacttgggcaacttgggtgttagattgactaaattgagtaaagtccaatctgaatacttgggtattccagaagaaggtccattcaaggccgaccactacagatattga

SEQ ID NO: 511 - DNA, 378 bp, Saccharomyces cerevisiae
atgaacgtcgttagagtctggccattttctacacgaactataccttgtaccactacagtggcagcttggtggacatgttgcgtgacagtcacagcaactggggcagataaagcgacagatgcagatgcggccagtagtgagactttagaaaatttcatctttgtaagttttattaaaggaatggtattgttttatgatgggctgtttcgaggaacgatgataccaagagccaacagatccatcacagcaatatgtaacactctgcgacaagcatatatatatacaaagatccaaagcattgcctttgaacgacgtctatgtttccaaaacattacatatagagaagtgcgtgagatacacgaaatgtactgtaaatag

SEQ ID NO: 512 - DNA, 1026 bp, Saccharomyces cerevisiae
atgagactgccagaaatctccatttggaaagtgatactactacttcatttgtttgctctacaagaatttcaacttgtctccgctgcaaatttgccctctttatcaagtagtacaaaggcagcagatagttctagtaaaggcagctcttcagccaagacaaccacgtccttaggcaaaagctcagtaaccagtaaggatgtttcgtcaagtcataatgtcacttcaagcactaaaatgcccaaaatcaccacgagcgctagtacaagcttatacaccaactctagtttatggagcaacaacagtgtaatatcaacttcatctattacaccttccagcgtttatatcccggttacggacggaaataaattcttatatcaggctcatcatcctaacggtactgtgttcattgcatttgctggctgtttaggtgcaattctactatcactgacgggtgcatggattgcattgaatataaagtcatggcgaagtgctagaaaggaaaataagctgagaaatctagaaaatcaataccaacacgatcctttctacttccaaacaaacattaatgacgacgaaagtgaaacatcttcccattctgacgacagtgacatatcagaaaaagttctgaaaaataactcatctcgtatgagtttgtatactctaggatccacttctgttttgaatcttttgaacaataaaacagatgccaacgataacttcagatcatctatgtttatttcacccaccgaaattctgcaatctgatgccaacaactctaatacatggtctcaaagcaatgagagtgctatatatgattccttgtccagtactccaagggaacctggtgctacccaaatactgggaaagtttacagacagcactaatccattcaattatacatcatacaatttaagtcccgactctgaagaccgctctactccaaaatcaaatgttagtcagggtaaagtaaagaagtaccgtcctcccagtgttcatctggatcaactgctcgacggtaaggaataa

SEQ ID NO: 513 - DNA, 1356 bp, Saccharomyces cerevisiae
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataa

SEQ ID NO: 514 - DNA, 1686 bp, Saccharomyces cerevisiae
atgagtactcctgcaaactatacccgtgtgcccctgtgcgaaccagaggagctgccagacgacatacaaaaagaaaatgaatatggtacactagattctccggggcatttgtatcaagtcaagtcacgtcatgggaagccactacctgagcccgttgtcgacacccctccttattacatttctttgttaacatatctaaattatttgattctgattatattaggtcatgttcacgacttcttaggtatgaccttccaaaaaaacaaacatctggatcttttagagcatgatgggttagcaccttggttttcaaatttcgagagtttttatgtcaggagaattaaaatgagaattgatgattgcttttctagaccaactactggtgttcctggtagatttattcgttgtattgatagaatttctcataatataaatgagtattttacctactcaggcgcagtgtatccatgcatgaacttatcatcatataactatttaggcttcgcacaaagtaagggtcaatgtaccgatgccgccttggaatctgtcgataaatattctattcaatctggtggtccaagagctcaaatcggtaccacagatttgcacattaaagcagagaaattagttgctagatttatcggtaaggaggatgccctcgttttttcgatgggttatggtacaaatgcaaacttgttcaacgctttcctcgataaaaagtgtttagttatctctgacgaattgaaccacacctctattagaacaggtgttaggctttctggtgctgctgtgcgaactttcaagcatggtgatatggtgggtttagaaaagcttatcagagaacagatagtacttggtcaaccaaaaacaaatcgtccatggaagaaaattttaatttgcgcagaagggttgttttccatggaaggtactttgtgtaacttgccaaaattggttgaattgaagaagaaatataaatgttacttgtttatcgatgaagcccattctataggcgctatgggcccaactggtcgcggtgtttgtgaaatatttggcgttgatcccaaggacgtcgacattctaatgggtactttcactaagtcgtttggtgctgctggtggttacattgctgctgatcaatggattatcgatagactgaggttggatttaaccactgtgagttatagtgagtcaatgccggctcctgttttagctcaaactatttcctcattacaaaccattagtggtgaaatatgtcccggacaaggtactgaaagattgcaacgtatagcctttaattcccgttatctacgtttagctttgcaaaggttaggatttattgtctacggtgtggctgactcaccagttattcccttactactgtattgtccctcaaagatgcccgcattttcgagaatgatgttacaaagacggattgctgttgttgttgttgcttatcctgctactccgctgatcgaatcaagagtaagattctgtatgtctgcatctttaacaaaggaagatatcgattatttactgcgtcatgttagtgaagttggtgacaaattgaatttgaaatcaaattccggcaaatccagttacgacggtaaacgtcaaagatgggacatcgaggaagttatcaggagaacacctgaagattgtaaggacgacaagtattttgttaattga

SEQ ID NO: 515 - DNA, 1989 bp, Saccharomyces cerevisiae
atgactaaagaaacgattcgggtagttatttgcggtgatgaaggggttggtaaatccagtctgattgtatcattaacaaaagctgaattcataccgaccatacaggacgtgctgccacccatcagtatcccaagagatttctcatcatcacctacatattctcctaagaatacagtacttatagacacttcagattcggacctcatagctttagaccatgagttgaagtccgccgacgtaatttggcttgtgtattgcgatcacgaatcgtatgaccatgtttctctcttttggttgcctcatttcagatccctggggttgaatattcctgtcattctctgcaaaaataaatgtgattccatatcgaatgttaatgccaatgcaatggtcgtgtcagagaacagtgatgatgatatcgataccaaagtggaggatgaagaatttatcccaatattaatggagtttaaagaaatcgacacttgcattaagacaagtgccaagacacagtttgatcttaaccaagcgttttatctttgccaaagggctataacacacccaatatcacctttatttgatgccatggtaggtgaactaaagccattggctgtcatggctttaaaaagaatttttcttttaagcgatttaaaccaggactcatatttagatgacaacgaaatcttgggcttacaaaaaaagtgcttcaataagagtatcgatgtaaacgaactgaattttattaaagatttgcttttggatatttccaagcacgatcaagagtacattaaccgcaagctatacgtaccgggaaaaggcatcaccaaagatggtttccttgtactgaacaaaatatacgctgaaagggggagacacgaaactacatgggctatcctaagaactttccattacacagattccttgtgtattaatgacaaaattctccatccgaggttggttgtccctgacacttccagtgtggaattgagccccaagggctacagatttcttgtagatatttttttgaagtttgatatcgacaatgatggtggtttgaataatcaagaattacatcgtctatttaagtgcacaccagggctgcctaaactatggacctcaacgaatttccccttctccactgtcgtaaacaacaagggttgcatcaccttacaaggctggctagcacaatggagtatgacgactttcttgaactatagcacaactaccgcttacttggtgtattttggctttcaggaagatgcaagactagccctacaagtaaccaagccaaggaaaatgagacgccgttccgggaaactttacagatccaatatcaatgacagaaaagtgttcaattgctttgtcattggaaagccatgttgcggcaaaagctctttgctagaggccttcttgggcagatctttctcggaggagtattctccgacaatcaaaccaagaattgcagtcaatagtttagaactcaaaggtgggaaacagtactatttgattttgcaagaacttggagaacaggaatacgccatactagagaataaggataagttaaaagaatgtgacgtaatctgtctaacatacgattccagcgacccagaatcattctcctacttagtttcgcttctagacaaattcacacatttacaagatctaccgttggtatttgtagcttctaaggcagatttggataagcagcaacaaaggtgtcaaatccaaccagatgaactggcagacgagctatttgtgaaccacccactgcacatatcatccagatggctaagttcccttaatgaattgtttattaaaatcacagaagctgctcttgatcctggcaaaaacactccgggattgccagaagaaacagcagcaaaagatgtcgactacagacaaacggctctcatttttgggtccactgttggattcgtagcactatgttcctttacgttaatgaaattattcaaatcatcaaaattctcaaaataa

SEQ ID NO: 516 - DNA, 2004 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggtctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggagtcttcagaaaagcaccataaggaaatatggatacaatttggcaccctacatgttcttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttagctacagcgcaacgtatacgtcgacgatacaacaagaacggttcatcggagcctcgactaaagacgcttgacggactcacttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccggaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcatctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgttgctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagcttgggtgctgcagaaaaggtgtctcgcacaaaggagtttgtcactga

SEQ ID NO: 517 - DNA, 1152 bp, Saccharomyces cerevisiae
atgattgtttcatttggtgatgcaacaacaagaacttccgaagttcaattggttaggtgtactcaaggtctaaacctttggaagctgcatcaagttcatgccgtttacaaaagagttgtccatgataccttaggtgccgatgaaggtaatgctttactcgatcaaattttggctgacacgaatctatatccaccttggatgtgtgttcttttatatgcattttgttccgctatggtcactccgtatgcctttggtggcgattgggtaaacctggcaatctcattttttatggggctttgtgtggggtcattacaatttattctttcacaaaagtcatacatgtattcaaacgtcttcgaaatttctgcatctattgtcgttagcttctgcggtagagcttttggctctatccctcgttctcacatctgctttggtgcagttacacaaggctcattggcattaatcctgccaggttatattattctgtgtggtgcactagaactgcaaagtcgaagcctagttgctggcgcggtccgtatgttctacgccattatttattctttgtttttgggttttggcataacattgggctcagctttgtttggatggatgtatcacaatgccactaacgaaatttcatgtcctcaattaatttctccgtggttcaggttcctcttcgttccagcgtttaccattagtatctcgttattaaatcaagcacacatctcacaactgccagttatggtcttcatttcttgcaccggttatgtcgtaacatattgggccggtaagcattttgcgaattcgacagagtttactgccgccttagctgcatttgtcataggtgttttaggtaatctatattccagaatttggaaaggtttagcggtatcagctatgcttcccgcaatcttcgttcaagtgccatctggtattgcttcacaaaattcgttgttgtctgggttgcaaagtgcaaatacaattgttaatgctaatgaaaccattacgacaagcacctccgatccatcgtcctcaatgtcatttggtatgacaatgattcaagtttgtgtcggtatttctgtgggactatttgcttcttcactctttgtctacccctttggtaaaaagaaaactggtcttttcagtttataa

SEQ ID NO: 518 - DNA, 2424 bp, Saccharomyces cerevisiae
atgaactcatccaataataacgactcgtccagctccaatagcaacatgaataactccttgagcccgacccttgtgacccacagtgatgctagtatgggctcgggtagagcaagcccagacaatagccatatggggagaggtatatggaatccatcgtacgtaaatcaaggctctcaaaggtctccacagcagcagcatcagaatcatcaccagcagcagcagcagcagcaacaacaacaacaacagaattctcaattttgctttgttaacccttggaatgaggaaaaagtaactaattctcaacaaaacctggtgtatccccctcaatacgatgacttaaacagtaacgaaagtctagatgcgtacagacgacgtaaatctagtctcgttgtacctccagccagggcacctgccccaaatcctttccagtacgatagttatcccgcttacaccagctctaatacgagtttggcaggaaatagcagtggccagtatccttctggctatcaacaacaacaacagcaagtataccagcagggcgctatccatccttcccaatttggatccagatttgttccctccctttatgatcgtcaagatttccaaagaaggcagagtctggctgcaactaattattcgtccaatttttcttccctaaattcaaatactaatcaaggaacaaactccataccagtcatgtcaccttacaggaggcttagcgcatatcctcctagtacaagtcccccactacaaccccctttcaagcagttacgaagagatgaagtacaaggtcagaaattgtccattcctcagatgcaactttgcaactctaaaaacgatcttcaacctgtcttaaatgctactccaaagtttagacgtgcgtcgctcaattccaagacgatatctcccctagtcagtgtcacgaaaagcctgattaccacatattctttatgttctccagaatttacctaccaaacgtccaaaaaccccaagagagtacttacgaagcccagtgaagggaaatgtaacaacggattcgacaacataaacagtgactatattctttatgtaaatgacgttttgggtgtagagcagaacagaaagtaccttgtgctagacattttgggtcaaggtacatttggtcaagtggtcaaatgtcaaaatttgctgacgaaagagatattggctgtaaaagtggttaaatcgaggacagaatatttgactcaaagtataacggaggctaaaattttagagctactgaatcaaaagatagaccctactaataaacatcattttttaaggatgtatgactcctttgtccacaagaaccacttatgtttagtgtttgaattactaagcaataatttgtacgaattattaaaacaaaacaaatttcatgggctctctatacaacttatcagaacattcaccactcaaatactggattcgttatgcgttttgaaggaaagcaaactgattcattgcgatctgaagccagagaatatcttgctctgcgcacctgataagccggaattgaaaattattgattttggctcatcttgcgaagaggcaagaaccgtttatacatacatccagtccaggttttatcgtgctcctgaaattatactgggtataccgtattcaaccagtattgacatgtggtcgttaggttgtattgttgctgaattatttttgggtataccgatcttcccaggcgcttctgaatataaccaattaacaagaataatagacacgcttggatatcctccatcgtggatgatagatatgggtaaaaactctggaaaatttatgaagaaattggcaccagaagaaagttcttcttctacacaaaagcatcgtatgaaaactattgaagagttttgcagagaatacaatatagtggaaaagcccagtaaacaatattttaagtggagaaagttaccagatattattagaaactacaggtatcctaaaagcatacagaactcccaagaacttatcgaccaagaaatgcagaatagggagtgtttgatccactttttaggcggtgtgctaaatttgaacccgttagaaagatggacaccacaacaagctatgctacaccccttcataacaaagcaggagtttacaggtgagtggtttcctccaggatcgtctttaccgggtccttcagaaaaacatgacgatgcaaaaggccagcaaagtgaatatggaagtgcgaacgactctagtaacaatgcaggccacaactatgtctataatcctagctctgccactggtggtgctgatagcgtcgacattggtgctatcagtaaaaggaaggagaatacatctggcgacatctccaataattttgctgttactcattctgttcaagaagggccaacaagcgcgttcaataaacttcacattgtcgaagaataa

SEQ ID NO: 519 - DNA, 2460 bp, Saccharomyces cerevisiae
atgtggaaatggaatgtgcgcagatgggcgggcgcaagagtaaacattagcaagaaccgattaagtgtaattaacgttggaagtagatacttatcgaccgcaagaagtccactgtctaaggttagaaatataggaattatagcccatatcgatgcaggtaaaactaccacaacagagaggatgctttattatgcaggaatctcaaagcatattggagacgtcgacactggcgatacgataactgattttttagagcaggagagatcccgaggtatcacaattcaaagcgctgcgatttcattcccatggcgaaatacttttgcaataaatcttattgatacgccgggacatatagattttacttttgaagtgattagggctttgaaagttattgattcatgcgtggtcattttggacgctgttgccggcgtagaggcacagacagagaaggtttggaagcaaagtaaatcgaagcccaaaatctgctttatcaacaaaatggatcgtatgggggcgagtttcaaccatacagtcaatgacttgataaataaatttatgagaggaacaactaccaaaccggtgttggtaaacattccttactatcgaaaacaaccgactagcaatgattatgttttccaaggtgttattgacgtcgtaaatgggaagcgattaacctggaatccagaaaatcctgatgaaattatcgtggatgagttggatggtacttctcttgagcagtgtaatcgttgtagggaatcgatgatagagactttgactgaatacgacgaagatttagtccagcacttcttagaggaggcagaaggcgattactccaaggtttccgcacagtttttgaacgcttcaataagaaaactgactatgaagaatatgattgtacctgtcttatgcggtgcgtcttttaaaaatattggcgtgcagcctctattagatgctatagttaattatctcccttcgcccattgaagccgaactaccagaactaaatgataaaaccgttccaatgaaatatgaccccaaagttggatgtttagtaaacaacaacaaaaatctttgcattgctcttgcattcaaagtgattacggatccaatcaggggtaaacaaatattcattagaatttattcaggtacactaaacagtggcaataccgtttataattctactactggggaaaaatttaaattgggtaaattactgataccccatgcgggaacatcacaacctgtaaatattttaactgcgggccaaatcggattgcttactggctctacagtcgaaaacaacatatctactggagatacactaataacgcattcgtcgaagaaggatgggttgaaatcacttgataaaaaaaaggagttgacgttaaaaatcaattctatcttcattcccccaccagtttttggtgtttccatcgaaccaaggactttaagtaataaaaaatcgatggaagaagctttaaacactttaattactgaagatcccagtctttcaatttctcaaaatgatgagactggccaaacggttttaaacggtatgggtgaattacaccttgaaattgccaaggatcgattggttaatgacctaaaagcagatgttgaatttggtcagttgatggtgtcctacaaagaaacaattaattcagaaacaaatatagaaacgtatgagagtgatgatggatatagattctccttatctctgctaccaaattccgatgcccttcctaactgccttgcatatccattaggagtcaacgagaattttctgataatggaaaaaaatggtaattgggataaagaatggaaataccaagtttctttcgaatcaattctaaattctattattgcaagttgcattgtgggacttcaaagaggcggaaaaatagctaactttcccttatatgcatgctccatcaaaatcaatagcgattggtcagtcccacctgatattgaaactccacaagaaatcttaaaaattactagaaacttaatttttaaagctctcaatgacttaaaacctgaaaaatacaaccttctggaacccatcatgaatcttgatctaacaatccctcaatctgatgttggtacggtgttacaagatctaacaggagcaagaaaggctcaaattctgtctattgaagacgaatcaagcgtgtcaaattctggcgcatccacttgtaattctccagagaacagcaataggatatatattccctctgatgctgttacaaccctacacgcaaccaaagataaaaaaaacactcaagagaccagttctaatgtaaaaaaaattataaaagcgaaagtgccactaagggaaattaccacctacaccaataagctaaggagcttatcgcaagggaggggtgagttcaatattgaatattccgatatggagaaagttaccaacgatcgcctacaatcaatacttcacgacttgtag

SEQ ID NO: 520 - DNA, 1764 bp, Saccharomyces cerevisiae
atgttgtggaagcgtacttgcacaaggctaataaagcctattgcacaacctagaggaaggctggtgagaagatcatgctacagatacgcctcaacaggcacaggcagcaccgacagcagcagccagtggttaaaatactctgtcatcgcctcttcagctactctattcggttatttgttcgctaagaacctctattctagggagactaaggaagatttgatagagaagctggaaatggtcaaaaagatcgacccagtaaattctacgttaaagctgtcctcattggactcaccagactatttgcacgacccggttaagatcgataaggttgttgaggacctgaagcaggtgctgggaaacaagcctgaaaactactctgatgcgaaatccgatttggacgcccattcagatacctacttcaacacgcatcacccctctcccgagcaaagacctaggattatattattccctcatactaccgaagaagtttccaaaattttgaaaatatgtcacgataacaacatgccagttgtacccttctcgggcggaacgtccttggaggggcacttcctgcctacaagaattggagataccataaccgtagacctgtccaagtttatgaataacgtcgtaaaatttgacaagctggacctggacatcaccgtgcaggccggtctaccctgggaggatttgaatgactatttgagcgaccacggtttgatgtttggctgtgaccctggtccaggtgcacagattggtggttgcattgctaattcttgttcaggaaccaacgcctaccgttacggtaccatgaaggagaatattataaacatgactatagtgttgccggacgggaccattgtcaagacgaagaaaagacccagaaagtcgagcgctggctataacttaaatggtttatttgtgggaagtgaaggtaccttaggtattgttactgaagctactgtcaagtgtcatgtcaagcccaaagctgaaactgttgcggtggtatcctttgatactatcaaggatgcggccgcatgtgcttctaatctgactcagagtggtattcatttgaacgccatggagttactggatgaaaatatgatgaagttgatcaacgcatctgaatccacggacagatgtgattgggtagagaaaccaactatgtttttcaagattggtgggagatctcccaacattgtcaatgctcttgtggatgaagttaaggctgtcgcccagttaaatcactgcaacagttttcagtttgctaaagatgatgacgaaaaattggaattatgggaagctagaaaggtcgcgctatggtctgtgctagacgctgataagagcaaagacaaatcagctaaaatttggacaactgatgtagctgttcctgtgtcgcagttcgacaaggttattcacgaaactaaaaaggacatgcaagctagtaagctgatcaacgccattgttggtcatgcaggtgatggtaacttccatgcattcatcgtctacagaacccctgaagaacacgaaacctgtagccaacttgttgacagaatggtcaagagagcactgaacgcagaaggcacttgcacgggtgaacacggtgttggtattggtaaaagagagtacttgctcgaagaattaggtgaagcacccgtcgatttgatgagaaagattaagctagctattgacccaaagagaatcatgaacccggacaaaatctttaaaactgatccaaacgagcccgctaatgattacaggtga

SEQ ID NO: 521 - DNA, 1626 bp, Saccharomyces cerevisiae
atgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataa

SEQ ID NO: 522 - DNA, 2832 bp, Saccharomyces cerevisiae
atggtcaaatcataccaacgttttgagcaagcagctgcttttggtgtaatagcctccaatgccaattgtgtttggatacctgcgtcatccggaaatagtaatggtagtggaccaggacaattgattacgagtgctctcgaggacgttaatatatgggatattaagaccggggatttggtcagtaaattatccgatggcttacctccaggcgcatctgatgctagaggcgccaagccagccgagtgtacatatttggaggctcataaagatacggatttattagctgtcggttacgcagatggtgtcattaaagtttgggatttgatgtctaagactgtgcttttgaattttaacggtcacaaagcagctataacattattacaatttgatgggactggcacaagattaatttctggttccaaggactccaatatcattgtatgggatcttgttggagaagttggtctttataaacttagatcacacaaggattccattactggcttttggtgtcaaggagaagattggctgatcagcacctccaaagatggaatgatcaagctatgggacctaaaaacacatcaatgtatagagacacatattgcgcatactggagagtgttggggccttgcagtgaaggatgatttactgatcacaactggtactgatagtcaagtaaaaatttggaaactggatatagaaaatgacaaaatgggggggaaactaacagagatgggtattttcgaaaagcaaagtaagcaacgtgggttaaagattgagttcataacaaattcgtctgacaaaacctcttttttttacatccaaaatgctgataaaaccatcgagactttcagaattagaaaagaagaagaaatagcaagaggtttaaagaaaagagagaagaggctaaaagaaaaggggttgacagaagaagaaattgcaaaatctattaaagaatcctactcctcctttatattgcatccttttcaaaccataagatcattgtataaaataaaatctgcatcatggacaacggtctcaagttccaaacttgagttggtattaactacatcgagtaataccatagagtattattccattccatatgaaaaaagagacccaacaagccctgctcctctcaagacacatactattgaattgcaagggcaaagaacggatgtgcgtagtattgacatcagtgatgataacaaattacttgccacagcatccaatggttcattgaaaatatggaatatcaaaacacataaatgtatcagaactttcgaatgtgggtatgcattaacttgtaagtttttgccaggtgggctactagtcatactgggtacaagaaacggggagttacagctctttgatctagcatcatcaagtcttttggataccattgaagatgcacatgatgcggcaatttggtcgctagatctgacctcagatggtaaacgattagtgaccggatctgccgataaaactgtcaagttttgggatttcaaagttgaaaatagcctagtgccaggtaccaagaacaaattcctgcctgttttaaaactgcaccatgatacaactttggaattaactgacgacattttatgtgtacgggtttctcctgacgatagatatctagccatctcgttgctggataatactgttaaggtattctttttggactcaatgaagttttacctaagtttatatgggcacaaattacctgtactatctatcgatatttcatttgattctaagatgattattacgtcttccgcagacaaaaatatcaagatttggggtttagattttggtgactgtcacaagtctttatttgcccatcaggattcgattatgaacgttaaattcttaccacagtctcacaacttctttagttgttctaaagacgcagtggtgaaatattgggatggcgagaaatttgaatgcattcaaaaactatacgctcatcagagcgaagtttgggctttggcggttgctactgatggcggctttgttgtttcttcatcccatgatcacagtataagaatctgggaagaaaccgaggaccaggtatttttagaagaggaaaaggagaaagaacttgaagaacagtacgaggatacattgctaacttctttggaagaaggaaacggtgatgatgcatttaaagctgatgcatcgggtgaaggcgttgaagatgaagcatccggtgttcataaacagactttagaatcgttaaaggctggtgaaagacttatggaggcgctagatttaggaattgctgagattgaaggtttagaggcatataacagagatatgaagctatggcaaagaaagaagttgggtgaagcgccaataaaaccacagggtaacgctgttctaattgctgtgaataaaactcctgagcaatatattatggataccctgttaagaataagaatgtctcagttagaagatgcactgatggttatgccattctcatatgtcctcaaatttttaaaatttattgataccgttatgcaaaacaaaactttgctgcactctcacttaccattaatttgcaagaatttatttttcattatcaaatttaatcataaagaattggtttctcagaaaaatgaagaattgaaattgcaaataaatagagtaaagactgaattaagaagtgcattaaaatctaccgaggatgatctaggctttaatgttcaagggttgaaattcgtcaagcaacaatggaatctaaggcataactacgaattcgttgacgaatatgaccaacaggagaaagagagtaatagtgcaaggaagagagttttcgggaccgttatataa

SEQ ID NO: 523 - DNA, 1152 bp, Saccharomyces cerevisiae
atgagtgaaacagaattgagaaaaagacaggcccaattcactagggagttacatggtgatgatattggtaaaaagacaggtttgagtgcattgatgtcgaagaacaactctgcccaaaaggaagccgttcagaagtacttgagaaattgggatggtagaaccgataaagatgccgaagaacgtcgtcttgaggattataatgaagccacacattcctactataacgtcgttacagatttctatgaatatggttggggttcctctttccatttcagcagattttataaaggtgagagtttcgctgcctcgatagcaagacatgaacattatttagcttacaaggctggtattcaaagaggcgatttagttctcgacgttggttgtggtgttgggggcccagcaagagagattgcaagatttaccggttgtaacgtcatcggtctaaacaataacgattaccaaattgccaaggcaaaatattacgctaaaaaatacaatttgagtgaccaaatggactttgtaaagggtgatttcatgaaaatggatttcgaagaaaacactttcgacaaagtttatgcaattgaggccacatgtcacgctccaaaattagaaggtgtatacagcgaaatctacaaggttttgaaaccgggtggtacctttgctgtttacgaatgggtaatgactgataaatatgacgaaaacaatcctgaacatagaaagatcgcttatgaaattgaactaggtgatggtatcccaaagatgttccatgtcgacgtggctaggaaagcattgaagaactgtggtttcgaagtcctcgttagcgaagacctggcggacaatgatgatgaaatcccttggtattacccattaactggtgagtggaagtacgttcaaaacttagctaatttggccacatttttcagaacttcttacttgggtagacaatttactacagcaatggttactgtaatggaaaaattaggtctagccccagaaggttccaaggaagttactgctgctctagaaaatgctgcggttggtttagttgccggtggtaagtccaagttattcactccaatgatgcttttcgtcgctaggaagccagaaaacgccgaaaccccctcccaaacttcccaagaagcaactcaataa

SEQ ID NO: 524 - DNA, 2175 bp, Saccharomyces cerevisiae
atgacgaaactattttcaaaggttaaggaaagcatagaagggatcaagatgccatctaccttgactattaatggaaaagccccaattgtggcttatgctgaactaattgctgctcgtattgtgaatgcgttagctcctaactccatagctattaagttggtggacgataagaaagcacctgctgccaagctcgatgatgctactgaagatgtcttcaacaagataactagcaaattcgccgccatcttcgataatggtgataaagagcaagttgctaaatgggttaatctggcccaaaaggaattagttatcaagaactttgctaaattatcacaatcattggaaacactagattctcaattgaacctaagaacctttattcttggcggcttgaagtattctgccgctgatgtagcatgttggggtgctttaagatccaatggtatgtgcggttccatcatcaagaacaaggttgatgttaacgtttctcgttggtacactttgttagaaatggatcccatcttcggcgaagctcacgatttcttgagcaaatctttactagaattaaagaaaagtgctaatgtgggtaagaagaaggaaactcacaaggctaactttgaaattgatttgccagatgccaaaatgggtgaagtcgtcactcgtttcccacctgaaccttctggatacttacatattggacatgccaaagctgccttgttgaaccaatattttgctcaagcttacaagggtaagttgattattagattcgatgacaccaacccatcgaaggaaaaggaagaattccaagactctattttggaagatttggatttattaggaatcaagggtgatagaataacctactcatctgactacttccaagaaatgtacgactactgtgttcaaatgatcaaggatggtaaagcttactgtgacgacactccaactgaaaagatgagagaagaacgtatggatggtgttgcttctgccagaagagatcgttctgttgaagagaacttaagaatttttaccgaagaaatgaaaaacggtactgaagaaggtttgaagaactgtgttcgtgccaagatcgattacaaggctttgaacaagactctaagagatcctgtcatttacagatgtaatctaacccctcaccacagaaccggatcaacttggaagatctacccaacttatgatttctgtgtcccaattgttgatgctattgaaggtgttacccacgctttacgtaccattgaatatagagaccgtaacgctcaatatgattggatgttacaagctttgcgtttgagaaaagtccatatttgggatttcgctcgtatcaatttcgttagaaccttgttgtctaagagaaagttacaatggatggttgacaaggacttggtcggaaattgggacgatccaaggttcccaactgtcaggggtgtgagaagaagaggtatgactgtcgaaggtttgaggaacttcgtcttatcccaaggtccatccagaaatgtcattaacttggaatggaacttgatctgggctttcaacaagaaggtcattgatccaattgctccaagacacactgctatcgtcaacccagttaaaatccacttggaaggctccgaagctccacaagaaccaaagattgaaatgaaaccaaaacacaagaaaaacccagctgtgggcgaaaagaaagtcatttactacaaagacattgttgtcgacaaagatgatgctgacgtcatcaatgttgatgaagaagtcactttaatggactggggtaatgtcattattactaaaaagaatgacgatggttctatggttgccaaattgaatttggaaggtgatttcaaaaagaccaagcacaagttgacttggttagctgatactaaagatgtcgtccctgttgatttagttgacttcgaccatttgattaccaaggacagattggaagaagacgaaagtttcgaagatttcttgactcctcaaacagaattccacacggatgccattgctgacttgaatgttaaggatatgaagattggtgatatcatccaattcgaaagaaagggctactacagattggatgctttacccaaggatggtaagccatatgtcttttttaccatcccagatggtaaatctgtcaacaagtatggtgcaaagaaataa

SEQ ID NO: 525 - DNA, 336 bp, Saccharomyces cerevisiae
atgtttgccattatctgtatgaattcattgaactgcaatcgcaacggcagaatttcatcgcgtgcttcgttgatctgcttacacactttgtccctggtttcattctcgttcttagccaatatcacttgtaaatcatctagcttgacgcctgccggtataatcgagtccattccggttgtctttactgctgttgtgtccgttttgcgctgcctaattgaagaagtcttggtgactgtttctgttgttctctttaaaatttcgctcggcgccataccgaaaatcctcaggaaagtgttagtgttatatattatattatattatatcatattatattaa

SEQ ID NO: 526 - DNA, 1878 bp, Saccharomyces cerevisiae
atggtgccattggaagatctgcttaataaagaaaatggcactgccgcacctcaacacagccgggagagtatagtagaaaatgggacagacgtttctaacgtcacaaagaaggacgggctgcccagtcctaacctatctaaaaggtcttctgattgttcgaagaggcctagaattaggtgtaccacggaagctattggcttgaacggtcaagaagatgaacggatgtcaccaggcagcacttcttcatcatgcttaccatatcatagtacttcacacttgaacactcctccatacgatctattgggcgcttcggcagtttcacccaccacatcatcttcctctgactcgtcctcctcctcgccattggcacaagcgcataacccggcaggtgatgacgacgatgcggataatgacggtgattctgaggatataacactatattgtaaatgggacaactgtggtatgattttcaaccaaccagagctgctatataatcatctgtgtcatgaccatgttggcaggaagtcacataagaacctacaattgaattgtcattggggagactgtaccacgaagacggagaaaagggaccatatcacctcgcatttgagagttcacgtaccattgaaaccgttcggttgctctacgtgctccaaaaagtttaaacgtccgcaagatttaaaaaagcatttgaaaattcatctggaaagtggcggtattttgaaaagaaagaggggacccaaatggggctcaaaaagaacttctaagaaaaacaaaagttgtgcaagcgacgcagtgtcgtcttgttctgcatctgtgccttccgctatagctggtagctttaagtcacattctacttctccacagatattacccccattgcccgtgggtatatctcaacatctgccttcacaacagcagcagcgggctatttccttaaaccaactatgctcagacgagctatctcagtataagccggtatattctccacaattgagtgccagattgcaaacgatcttgccgccattatactacaataacggcagcacggtaagccaaggtgccaacagtcggagcatgaatgtctacgaggacggttgttctaataagaccatagcaaacgccacccaattcttcaccaaactatcgagaaatatgacaaataactacattttgcaacaaagcggtggtagtactgagtcctcgtcatcatctgggcgcatccccgtagcacaaacaagctatgtgcagccacctaatgctccttcataccaatccgtacaaggtggtagctctatttcggccactgcaaatacagcaacttatgtgccagtacggttggccaagtatccaactggtccttcgcttactgaacatttgccacctttacattcgaacactgccggtggtgttttcaaccgccaatcacagtatgctatgccacactatccatctgttcgtgctgcgcctagctattcctccagtggctgttctatattaccgcctctacaatcaaagataccaatgttaccatcgcgccgtacaatggcaggtggaacttcattgaagcctaactgggaatttagcctgaaccaaaaaagctgtactaatgatattatcatgagtaagctggcgattgaagaagtagatgacgaaagcgagatagaggatgatttcgtagagatgttgggtatagtgaacattatcaaggactacttgttgtgctgtgtcatggaagatttagatgatgaagaaagtgaggacaaagatgaagaaaacgcattcttgcaagaatctttagaaaaattgagtttacaaaaccaaatgggaactaactcagttcgcatcttgaccaagtatcccaaaattttggtatga

SEQ ID NO: 527 - DNA, 4434 bp, Saccharomyces cerevisiae
atgacgattaccgtgggggatgcagtttcggagacggagctggaaaacaaaagtcaaaacgtggtactatctcccaaggcatctgcttcttcagacataagcacagatgttgataaggacacatcgtcttcttgggatgacaaatctttgctgcctacaggtgaatatattgtggacagaaataagccccaaacctacttgaatagcgatgatatcgaaaaagtgacagaatctgatattttccctcagaaacgtctgttttcattcttgcactctaagaaaattccagaagtaccacaaaccgatgacgagaggaagatatatcctctgttccatacaaatattatctctaacatgtttttttggtgggttctacccatcctgcgagttggttataagagaacgatacagccgaacgatctcttcaaaatggatccgaggatgtctatagagaccctttatgacgactttgaaaaaaacatgatttactattttgagaagacgaggaaaaaataccgtaaaagacatccagaagcgacagaagaagaggttatggaaaatgccaaactacctaaacatacagttctgagagctttattattcacttttaagaaacagtacttcatgtcgatagtgtttgcaattctcgctaattgtacatccggttttaaccccatgattaccaagaggctaattgagtttgtcgaagaaaaggctatttttcatagcatgcatgttaacaaaggtattggttacgctattggtgcatgtttgatgatgttcgttaacgggttgacgttcaaccatttctttcatacatcccaactgactggtgtgcaagctaagtctattcttactaaagctgccatgaagaaaatgtttaatgcatctaattatgcgagacattgttttcctaacggtaaagtgacttcttttgtaacaacagatctcgctagaattgaatttgccttatcttttcagccgtttttggctgggttccctgcaattttggctatttgcattgttttattgatcgttaaccttggacccattgccttagttgggattggtatttttttcggtgggtttttcatatccttatttgcatttaagttaattctgggctttagaattgctgcgaacatcttcactgatgctagagttaccatgatgagagaagtgctgaataatataaaaatgattaaatattatacgtgggaggatgcgtatgaaaaaaatattcaagatattaggaccaaagagatttctaaagttagaaaaatgcaactatcaagaaatttcttgattgctatggccatgtctttgcctagtattgcttcattggtcactttccttgcaatgtacaaagttaataaaggaggcaggcaacctggtaatatttttgcctctttatctttatttcaggtcttgagtttgcaaatgtttttcttacctattgctattggtactggaattgacatgatcattggattgggccgtttgcaaagcttattggaggctccagaagatgatccaaatcagatgattgaaatgaagccttctcctggctttgatccaaaattggctttaaaaatgacacattgctcatttgagtgggaagattatgaattaaacgacgctattgaagaagcaaaaggagaagctaaagatgaaggtaaaaagaacaaaaaaaagcgtaaggatacatggggtaagccatctgcaagtactaataaggcgaaaagattggacaatatgttgaaagacagagacggcccggaagatttagaaaaaacttcgtttaggggtttcaaggacttgaacttcgatattaaaaagggcgaatttattatgattacgggacctattggtactggtaaatcttcattattgaatgcgatggcaggatcaatgagaaaaactgatggtaaggttgaagtcaacggggacttattaatgtgtggttatccatggattcaaaatgcatctgtaagagataacatcatattcggttcaccattcaataaagaaaagtatgatgaagtagttcgtgtttgctctttgaaagctgatctggatattttaccggcaggcgatatgaccgaaattggggaacgtggtattactttatctggtggtcaaaaggcacgtatcaatttagccaggtctgtttataagaagaaggatatttatctattcgacgatgtcctaagtgctgtcgattctcgtgttggtaaacacatcatggatgaatgtctaaccggaatgcttgctaataaaaccagaattttagcaacgcatcaattgtcactgattgagagagcttctagagtcatcgttttaggtactgatggccaagtcgatattggtactgttgatgagctaaaagctcgtaatcaaactttgataaatcttttacaattctcttctcaaaattcggagaaagaggatgaagaacaggaagcggttgttgccggtgaattgggacaactaaaatatgaatcagaggtaaaggaattgactgaactgaagaaaaaggctacagaaatgtcacaaactgcaaatagtggtaaaattgtagcggatggtcatactagtagtaaagaagaaagagcagtcaatagtatcagtctgaaaatataccgtgaatacattaaagctgcagtaggtaagtggggttttatcgcactaccgttgtatgcaattttagtcgttggaaccacattctgctcacttttttcttccgtttggttatcttactggactgagaataaattcaaaaacagaccacccagtttttatatgggtctttactccttctttgtgtttgctgctttcatattcatgaatggccagttcaccatactttgcgcaatgggtattatggcatcgaaatggttaaatttgagggctgtgaaaagaattttacacactccaatgtcatacatagataccacacctttgggacgtattctgaacagattcacaaaagatacagatagcttagataatgagttaaccgaaagtttacggttgatgacatctcaatttgctaatattgtaggtgtttgcgtcatgtgtattgtttacttgccgtggtttgctatcgcaattccgtttcttttggtcatctttgttctgattgctgatcattatcagagttctggtagagaaattaaaagacttgaagctgtgcaacggtcttttgtttacaataatttaaatgaagttttgggtgggatggatacaatcaaagcataccgaagtcaggaacgatttttggcgaaatcagattttttgatcaacaagatgaatgaggcgggataccttgtagttgtcctgcaaagatgggtaggtattttccttgatatggttgctatcgcatttgcactaattattacgttattgtgtgttacgagagcctttcctatttccgcggcttcagttggtgttttgttgacttatgtattacaattgcctggtctattaaataccattttaagggcaatgactcaaacagagaatgacatgaatagtgccgaaagattggtaacatatgcaactgaactaccactagaggcatcctatagaaagcccgaaatgacacctccagagtcatggccctcaatgggcgaaataatttttgaaaatgttgattttgcctatagacctggtttacctatagttttaaaaaatcttaacttgaatatcaagagtggggaaaaaattggtatctgtggtcgtacaggtgctggtaagtccactattatgagtgccctttacaggttgaatgaattgaccgcaggtaaaattttaattgacaatgttgatataagtcagctgggacttttcgatttaagaagaaaattagccatcattccacaagatccagtattatttaggggtacgattcgcaagaacttagatccatttaatgagcgtacagatgacgaattatgggatgcattggtgagaggtggtgctatcgccaaggatgacttgccggaagtgaaattgcaaaaacctgatgaaaatggtactcatggtaaaatgcataagttccatttagatcaagcagtggaagaagagggctccaatttctccttaggtgagagacaactattagcattaacaagggcattggtccgccaatcaaaaatattgattttggatgaggctacatcctcagtggactacgaaacggatggcaaaatccaaacacgtattgttgaggaatttggagattgtacaattttgtgtattgctcacagactgaagaccattgtaaattatgatcgtattcttgttttagagaagggtgaagtcgcagaattcgatacaccatggacgttgtttagtcaagaagatagtattttcagaagcatgtgttctagatctggtattgtggaaaatgatttcgagaacagaagttaa

SEQ ID NO: 528 - DNA, 318 bp, Saccharomyces cerevisiae
tataagcttaacaggaaagaaaagaataaagacatattctcaaaggcatatagttggagcagctctatttatacccgttcctccatctgtcatcattacttaaacgattcgttaacagatgctcatttagtacctcacatattctccatatctcatctttcacacaatctcattatcactatgaagatgttcttgtttttgaacgaatcatacatctttgatagacttcgtatgtggagtattgttttatggcactcatgtgtattcgtatgcgcagaatgtgagaatgccaattataggggtgccgaggtgccttga

SEQ ID NO: 529 - DNA, 1818 bp, Saccharomyces cerevisiae
atgtcgtcaagcctttttatcctggatgaaaatctggagccattggtatcgaagaatattagagcactaccgaatctatcgtcggttctttcaagtttcaaacaatgttatcatgacgggtcgcctccaattctctcccaaaacgattggttctttatacatttgaagagagactttctgcatttcgtttcagtgatacataccacagacaaaccaaatatagacttaatgactatactagcctttttggaacaattttatcatcttttacaaaaatattttgaaatcgaggtcttaactaagaatgtcatactggacaacatcttacttgtcctggagttgattgatgaatgtatagactttggtatcgtacaagtgacggatccaagtatcatcaaggactacattcgtgtgaaggtcaacgtaccaagagttacagtagacaatgaggagtggagccctggtgaagagagcagtagtagtagcggtagcgatagcgatagcgagtacagcaatactaataagaggaaggataagaagaagaaaaggaagaagaaaaagggcactaaagggaaaagcgtgggcaaaagtaaattaaaaagtataatggtaaacaataaagaaaataggggcataaacgtggtggaaactgtcaaggagacactaaggaacaagaatgataccggtaaagaagccgctaatgacgagctccccaatgacggtaatgatttatacatcaatggcgatattgcgaagacgattataatgcccatatcatggagaacaaaggggatacattacgccaaaaacgagttctttcttgatgttattgaacgtgttcagtacttgatggattttgaaaaaggagtgattaggaaaaatctgatacatggagagattgtgtgcagatgctatttatcagggatgcccaaactgaaaatatccataaacaagatactgaacagggacccccagttcatgtcgaattccagctttcatcagtgtgtttcactagattccataaacactattgaaaaagatgaagaaaagaatagtgacgatgatgctggtttgcaggccgccacagatgcaagagaaatcgaatttataccgccggatggcgaatttgttctttgccaatacgagttgaagagacatgtaaaggatgcgccgatggtgaggttgaaagattttgaaatcaaacctaaactgaagaagtttaaaatccaaattgtaaccaaaattcaaacaaattttaaacccaccaactcaacgtcgaagctaaacgtgagaattcccctgacaaaagtcttccaggaatataaaatagacctcagcaagcaaattagattcaaggcaaacatcggcaaggtcgtgtttaacttgagtgacgattttctcctctgggagatacaaaccatgaaggggcaccgagaacatagcacaaacaagagctcacagtacaacagcgacgaagatgatccaaatacgtgtgcatccatggtggcagagttccccctcttcaaccaggaagaatatgaccgcctgcaagaagaaatgaaaacctcaatgaatccgccgcccttgcgcacgggacccaggctggaagaactatatagacaagtgcacgaccaacaaacttcccacgttactcctcgagataagttggtcaacattgatttcgagattccgtactgtacatgcagtggcctgaaagttgagtacttgaaggtcgaagagccacaattgcagtaccagtctttcccctgggtcagatacaagaccgtcagcgacgaagagtacgcatatattgtttga

SEQ ID NO: 530 - DNA, 3396 bp, Saccharomyces cerevisiae
atgagtggttcgcattcaaatgatgaggatgacgtagtgcaagtgcccgagacgtcctctcccaccaaggtagcatcgtcgtctcccttaaagcctacttcgccaacagttccggatgcaagtgtggcgtctttgagaagcaggtttactttcaagccttcagatcccagcgaaggagctcatacttcgaagccgctcccatctgggagtcctgaggtagcactggttaaccttgcgagagagttccccgatttctctcaaactctggtgcaggctgttttcaaatctaactcttttaacttacagtctgccagggaacgtcttacaagattgaggcagcaaagacaaaattggacatggaacaagaacgcatctcccaagaagtcagaaaccccgccacctgtcaagaagtcattaccactggcaaacacaggccgtttatcatctatccatggcaatatcaacaacaaatcctccaagattaccgtggccaaacagaaaacgtccatttttgaccgttactcaaacgtcatcaaccagaaacaatacacttttgagctgccaactaacttgaatatagactcggaggcactgagcaagttgcccgtgaactacaacaaaaagagaaggctggtaagggcagatcagcatccaattggcaagtcttatgagtcatccgctacacaattaggttctgcaagagagaaactactggcgaaccgcaaatacggtcgtcatgcaaacgacaacgatgaagaggaggaagagagtatgatgacggacgatgacgatgcaagtggcgacgactacacagaatccacgccgcagataaatctggatgaacaagttttacagtttattaatgactctgatattgtcgatctctcggacctctcagataccacgatgcataaggctcaactcatagcctcacataggccatattcttctttaaatgcctttgtaaacacaaatttcaatgataaggacactgaggagaacgcatcgaacaagagaaaaagacgtgcggctgcatccgccaatgagagtgagaggctgctcgataaaatcacccaaagtataagaggttacaatgcaattgagtctgtgatcaagaaatgttcttcctacggtgatttggtcacttcgcaaatgaagaaatggggtgtgcaagtggaaggcgataactctgagttggacctgatgaaccttggggaagacgatgacgacgacaatgatgatggcaataacgataataataatagcaacaataacaataccgctggcgcagacgccactagcaaggaaaaagaagatacaaaggccgtagtggaaggttttgatgaaactagcgcagaacctactccagcaccagcaccagcaccagtggaaagagaaacaaaacgaattagaaacacaactaagccaaaagtggtcgaagatgaagatgacgatgtagatttggaggcaatcgatgacgaattgccgcagtctgagcatgaagatgatgactatgaagaggaggacgaagactataacgatgaggaagaagatgtggaatatgatgatggtgacgatgatgacgatgatgacgatgaatttgtcgctaccagaaaaaacacacacgtgatctccaccacgagcagaaatggccgtaaacctattgtcaagttcttcaagggcaaacccagactgttaagcccggaaatttcactaaaagactaccaacaaacgggtataaactggttgaatctgctataccaaaacaagatgtcatgtatccttgcagacgacatgggtctaggtaaaacatgtcaagtcatttcatttttcgcatatttgaaacaaataaacgaaccgggtcctcacttggttgttgtgccatcatcgacgctagaaaattggttaagggagttccagaaattcgcacctgctttgaagattgaaccctactatggctctttacaagaaagggaagaattgcgtgatatcctggaaaggaacgctgggaaatatgatgttatcgtgaccacgtataacttggctgcaggtaataaatacgacgtttcgtttttgaaaaatagaaacttcaatgttgtggtttatgatgaaggtcatatgttgaaaaattccacttcagagagatttgccaaactgatgaaaattcgtgccaatttccgccttttattaactggtacgccattacaaaataacttgaaggaactaatgtcgctgttggaatttatcatgccaaatcttttcatttccaaaaaggaatcatttgacgcaatcttcaaacaacgtgccaagaccacagacgataacaaaaatcacaacccgctattagcgcaagaagccattacaagagctaaaacgatgatgaagccatttattttgagaagacgtaaggatcaagtgttgaaacatttgccaccaaagcacacgcatattcagtattgtgaattgaacgcaatacaaaaaaaaatatatgataaggaaatacaaatcgtgttagaacataagagaatgattaaagatggcgaattgccaaaagatgcaaaagaaaagtctaaattacaatcttcaagttccaaaaatttaataatggcattgcgaaaggcctctctgcatccacttttgttcagaaatatctataatgataaaatcatcactaaaatgagtgatgccatattggatgaacctgcttatgctgaaaacggtaacaaagagtatattaaggaagatatgagctatatgacggattttgagttgcacaaactatgctgcaatttcccgaacacgttatccaaataccaacttcataatgacgagtggatgcaatctgggaagatagacgctttgaaaaaattgctgaaaacaatcattgttgacaaacaggaaaaggtgctgatattttccttattcactcaagtcctggatattctagagatggttttgtccaccttagattataaatttttaagattagatggttccacgcaagtgaatgatagacaactactaatagataagttttatgaagataaggatattcccattttcatcttatcaacaaaggcaggtggattcggtattaatttggtgtgcgcaaataatgttattatattcgatcaaagttttaacccacatgatgacagacaagctgctgatagggcacatcgtgtgggacaaacaaaggaagttaatataaccactttaattactaaggattccatagaggaaaagattcatcaactggccaaaaataaactagctttagattcgtatatcagtgaagataaaaaatctcaagatgtgttggaaagtaaagttagtgatatgttggaggatataatttatgatgaaaactcgaaaccgaagggaaccaaagaataa

SEQ ID NO: 531 - DNA, 1551 bp, Saccharomyces cerevisiae
atgtctacacagcagcaatcttacacaatttggtctccacaagatactgttaaagatgtcgctgagtcgcttgggttggaaaatatcaacgatgacgtgttgaaagcacttgctatggacgttgaataccgtattctagagattattgaacaggcagtcaagtttaaaagacactctaaaagagatgttttaactacagacgatgtatcgaaggccctgcgtgttctgaatgtggaacctttatatggatattatgatggctctgaagttaataaagctgtatcatttagtaaggttaacacaagtggaggacagtcggtttactacctggatgaggaagaagtagattttgatagattaataaatgagccattaccgcaagtgcctcgtctaccaacttttactacacattggctagcagttgaaggggttcaacctgccataatccaaaatccaaatttgaatgatataagggtatcccaaccaccatttattagaggtgctattgtcactgctttgaatgataacagcctccaaacacctgtaacgtcgacgacagcaagtgcttctgtgacggatacaggcgcctctcaacacctgtctaatgttaaaccaggacagaatactgaagtcaaacctttagtgaaacacgttttatccaaagaattacagatttatttcaataaggtcatttcaaccttgacagcgaagagtcaagctgatgaagctgcacagcatatgaaacaagcagctttgacttcactacgaactgatagtggcctgcaccaactggttccatattttattcaatttattgccgaacaaatcacacaaaatctttccgatttacaattgctaacaacaattttggaaatgatttactctttactaagcaatacttctattttcctggacccttatattcattcgttaatgccttccattttaaccttgctattagcaaaaaaacttggtggatcaccaaaagatgattcgccgcaagaaattcatgaatttttagaaagaacgaatgcactacgtgattttgccgcatctttgttggactatgtattgaaaaaatttcctcaagcatacaaatccctgaagccaagagtaactaggacactgctaaagacatttttggacataaaccgtgtttttgggacttactatgggtgcttaaagggtgtatcggtactagaaggtgaatccatcagattcttcttaggaaacctaaataattgggcgcgcttggtattcaatgaaagcggaataactctagacaatatagaggaacatttgaacgatgactccaatccaactaggaccaaatttactaaagaagaaactcaaatcttggttgatactgtaattagtgcattgttagttctaaaaaaggatttaccagatttgtacgagggtaaaggtgaaaaagttacggatgaggataaggaaaaattgctagagaggtgtggtgtcactattggatttcacattttgaaaagagacgacgcaaaagaattaattagtgcgatattttttggcgaatag

SEQ ID NO: 532 - DNA, 1764 bp, Saccharomyces cerevisiae
atgagtaacaagaggacatctgtagaacagctcatatcatgcccaatttgctctagaaaagtctttttttccttaatcaactctcatcttgacatatgtggcaaggaaaagtcaaagccttcgagtaggccacaaacggtgtcaagtcttttggcaggcccaaaaaagaggaaacaagctaactcagagaaattcattgatcttgaaaataaggaccatgaaattaagccaggtcttaagagcgagagtgatgatattgagattgttgaaaatgaaagcaaaagatttaaggcagcaccatccacggattttgcgaaatcaatagtggagcctgcttcgagcagagatcaacttcacaacgattacgaaagcagatggttgcagaaaataagccatttgccacttagtgaaaaattgaggccaaaagaattaagagattatgtaggtcagcagcacattctctctcaagataatggtacattgttcaaatacataaaacaagggactataccatctatgatactctggggccctccaggtgtaggaaagacttcactagctagactattaacgaaaactgcgacaaccagtagtaatgaatcaaatgttggttccaggtacttcatgatcgaaacaagtgcgacaaaggcaaatacgcaagaattgagaggtatatttgaaaaatcaaaaaaggaatatcaattgaccaaaagaagaactgtactttttattgatgaaattcacagattcaataaagttcaacaggatttgttattgccacacgtagaaaacggtgacattattttgattggtgcaacgacagaaaatccaagttttcagctgaacaatgctctcattagcagatgtctgatttttgtcctagaaaagctgaatgtcaacgaactgtgtattgttttatcaagaggaattgcattattgaataaatgcaggaaacaagtatggaatattgaaaatcctttgaaattgtctagaagcatactggagtacgtggtagatctgtcggtgggtgatacaaggagggcgttaaatatgttggaaatgatcgaagtttcaacaagagagcgcaaggccgacgaggaagaattatctatcgatgatgtacgagacataattaagaacaacagcagcaacgggttgaatacatactatgacccaaagggagataaccattatgatacaatctctgcgtttcataaatccattagaggtggggacgaaaacgcctcactgtactatttagcaagaatgttgcagggaggagaggacccattgtatgttgcccgaagaatgattcgaatagcttctgaagatatcggattacgggatagttcattattgcccttggctgtcgcggcacatgacgcagtaatgaaagttggtttgccagaggcagaccttgcactggcgcaatgttgtgttgctttggctagggcaccaaagtcagtagaactatatagagcttggaagaaattaagggcaatgatgagcgagaacatgtacagtttagcaagcagtgagataccgatgcatatcagaaatgcgccaaccaaattgatggaggagctgggttatcataaaggctacaagtacaatcccgattatattgaaggaaaagtccaacaagactactttcccaaagaagtgctcgagaaatgtccaaataaaactgacttaaagttcctggacggcaaacatttaggagacaaagaagatcctgacttgagacagtcatatcagggttag

SEQ ID NO: 533 - DNA, 390 bp, Saccharomyces cerevisiae
atggcgggcactttattcattattctgcggtttgtcgatacgactcttccgtcatctagggtatattgtgtaaggtctctggaagtttctgtggccgtggaattagcagcagcaactgtactagccttcgaatctataggggttgtggacgattgcggacgctctgttttgttttctataattttaatagcggcgtttatctgctcagtatttcttatagcgtctgaagacattgcgggttcaagaagaagtactggctcctgtgtgactctatgggagggaaggaatatctccttttgtttgtatcgtagcaattggcttaatactgttccagttggatatatgttttttctaaggaaaaataggagtcttgatgaaaggtatttttag

SEQ ID NO: 534 - DNA, 1704 bp, Saccharomyces cerevisiae
atgtcaggtgttaataatacatccgcaaatgagttatctactaccatgtctaactctaactcagcagtaggcgctccctctgttaagactgaacacggtgactctaaaaattcccttaacctagatgccaatgagccacctattgacttacctcaaaaacccctctctgcgtataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacatatcagaggaactctggtccaattgtaccagctgatgggtacgatgggtatttttctaggatactgtaccaattacggtaccaagaactatcacaacgccactcaatggagagtcggccttggtctttgctttgcctgggctacattcatggttagtggaatgatgtttgtaccagaatcaccacgttacctgattgaggttggtaaagatgaggaagcgaaacgttcactatcgaaatccaacaaagtctcagttgacgatccagccttgctagttgaatatgacactataaaggcaggaattgaacttgaaaagctggcaggtaacgcatcatggtctgaactactctccactaaaacaaaggtctttcagcgtgttctcatgggagtgatgatccaatcgctgcagcaattaaccggtgacaactacttcttttactacggtaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttacgtattcttaggctgtctggtttttgcatacttttatgtctttttctttgtcccagaaacaaaaggcctgacactggaggaggtgaatactatgtggctggaaggtgtgccagcatggaaatcggcctcatgggtgccaccggagagaagaaccgcagattacgatgctgatgcaatagatcatgacaatagaccaatttacaagaggttcttttccagctga

SEQ ID NO: 535 - DNA, 3255 bp, Saccharomyces cerevisiae
atggaaggaattttggatttttctaacgacttagatatcgctctattagatcaggtggtatctacattctatcaaggttcaggtgttcagcaaaagcaagcccaagagattttgactaaatttcaagataatccagacgcttggcaaaaagctgaccaaattcttcaattctcaactaaccctcaatcaaaatttattgccctttccatccttgataaattaattactagaaaatggaaattgttgccgaatgatcatagaattggaattaggaacttcgttgttggtatgattatctccatgtgccaagacgatgaagtatttaaaacacaaaagaacctgatcaataagtcggacttgactttggtccaaattttaaagcaggaatggcctcagaattggcctgaatttatcccagaactaatcggcagttcaagttcctctgttaatgtttgtgaaaataacatgatcgttttgaaactgctatccgaagaagtcttcgatttctctgcggaacaaatgacacaagctaaagctttacatttgaaaaattccatgtcaaaagaatttgaacagatttttaaattatgttttcaagttttggaacaaggttcttcaagctctctaatagtggcaaccttagaatctttactgagatatttacattggattccttatcgttatatttatgaaaccaatattttggaattattaagcaccaaattcatgacatcgcctgatacaagagccatcacattgaaatgtttgactgaggtttcaaatctaaaaattccacaagataatgatttgataaaaagacaaactgtactttttttccaaaatactctacaacaaattgccacaagtgtgatgcccgtgactgccgatctgaaagccacttatgcaaatgctaacggtaatgatcaatctttcttacaagatttagcaatgtttctaactacatatctcgctcgtaatagggcccttctagagagtgatgaatcgttaagagagttgttgttgaatgcgcaccaatacttaattcaattatccaaaatcgaagaaagagaactatttaagacgacattggattactggcataatttagtagcagatttgttttatgaggttcagcgtttgcctgctaccgaaatgagcccattgatacagttatcagtcggttcacaagctatctcaactggatctggcgccctaaatccggaatatatgaaaagatttccattaaaaaaacatatttacgaagaaatttgttcacagttgagattggtcattattgaaaatatggttagaccagaagaagtccttgtggttgaaaatgatgaaggagaaattgttagagagttcgttaaagaatcagacactatccaattatacaaatcagaaagagaggttcttgtatatttgacccatttgaatgttatcgatacagaagaaatcatgatcagtaaattggcaaggcaaatcgatggttccgaatggtcatggcataatatcaacactttatcttgggctattggttccatatctggtacaatgagcgaagatactgaaaaaaggtttgtagttactgttattaaagatttactagatttaacggtcaagaaaaggggtaaagataataaagctgttgttgcatcggatattatgtacgtcgtgggccaatatcctagatttttgaaggctcactggaattttctaagaacagttattttgaaactttttgaatttatgcatgaaactcatgagggtgttcaggatatggcatgtgacacattcattaagattgttcaaaaatgtaaatatcattttgttattcaacaaccccgtgagtctgagcctttcatccaaacaataattagggatattcaaaagacaactgctgacctacagccgcaacaggtccatacattttacaaggcttgtggtattattatttctgaagaaagaagcgtagcggagagaaatagattattaagtgatttgatgcaactgccaaatatggcttgggacactatagtggaacaatccactgctaacccaacattgttgttagattctgaaactgtcaaaattattgcgaatattataaaaaccaatgtagctgtctgcacctcaatgggagcagatttctatccacagttgggtcacatctattacaatatgcttcagctatacagagctgtttcttcgatgatttctgctcaagttgccgcagaaggtctaattgctacgaagacaccaaaggttcgtggtttgagaaccatcaaaaaagagattctgaagcttgttgagacctatatatccaaggcgagaaatttggatgatgtcgttaaagtgttagttgagccattattgaacgctgtacttgaagactatatgaacaacgttcctgatgcaagggacgccgaagtgctaaattgtatgacaacagtagtagaaaaggttggtcatatgatcccacaaggtgttattttaattttacagagtgtatttgaatgcactttggacatgattaacaaagacttcacagaatatccagagcatcgtgtagaattttacaagttattgaaggtcatcaatgagaaatcatttgctgcatttttggaactacctccggctgcctttaaattgtttgttgacgctatttgttgggcgttcaaacataacaatagagatgtcgaagttaatggtctacagattgcattagacctagtgaaaaacattgaaagaatgggaaatgtcccatttgcaaatgagttccacaagaattattttttcatttttgtcagtgaaacgttttttgttttaaccgattccgaccacaaatccggtttttctaagcaagctttgttactaatgaagttgatttctttggtttatgataacaagatttcggtaccattatatcaagaagctgaggtaccacaaggaacttcaaatcaagtctacttaagccaatatttggctaatatgttaagtaatgcattcccccatttaacatccgaacaaatcgcaagttttctctctgcattaactaaacaatacaaagacttagtggtcttcaaaggcactttgagggactttttggtgcaaatcaaagaagtcggaggtgatccaacagattatttgtttgctgaagataaagagaatgcattaatggaacagaatagactagagagggaaaaagctgccaagattggtgggttattaaaaccttccgaacttgatgattag

SEQ ID NO: 536 - DNA, 5580 bp, Saccharomyces cerevisiae
atggaaattgaaaacgaacagatttgcacctgcatagcgcagattctgcatcttctcaatagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggtctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggggtcttcagaaaagcaccataaggaaatatggatacaatttggcaccctacatgtttttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatattttgcatattatcttgcgagcatgtgcgctcaatttcggggcgggtccccgtggtggcgctggtgacgaagaggatcgatccattacgaatgaagaacccattattccctctgtggacgagcatggcttgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcgatgtggaaatggatcaaaattctgtaccacgaagtagcgcaggaaaccgcgctgaaggactcttatagaataactttggtaccttcttctgatggtgtatcagtatgtggaaaactgtttaatcgcgagtatgtccgcggcttttactttgcatgcaaggctcagtttgataacctttgggaagaattgaacgactgcttttatatgcctacagtggttgatattgccagcctcattttgcgtaatcgagaagttttgttcagagagccaaagcgaggaattgacgagtatctggagaacgattctttccttcaaatgatacctgttaaatatcgtgaaattgtgctgcccaagttgagaagagatactaacaaaatgaccgcggctcttaaaaataaagtcactgttgcaattgacgagcttacggtgccacttatgtggatgatccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatcatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgactaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctgcaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatatattattatgtagagattcgagcagagaagttggagagtga

SEQ ID NO: 537 - DNA, 2436 bp, Saccharomyces cerevisiae
atggtaatcttcaaagaacgcaaaccaacagaaaaccttttcactagaaaaatacctgccaagtacttcatcttctcgcctagttttttgtctgttcattattttgaattttatttgcccatgtccggtgataataacattgaacctactagtcggggctcgaacgacaatagcaacggtccaagtaacggatcttcggtaaacagtaatcggtacagtttaaacgcacccaagtacagcagccaaccaccgccagcatcacacacttatttgccccccatgtcagtgaatatcccgcccatagcgagcaaatcatcgtcaatatacagcctgctacaccaaagttccccccgcccggagacgccaaatccaatattaccgccacttatcggtagtggtcccggctcccataaaccatctcctacccctacacagcctcctgcacaacccgcaacacaacggcaacctgccacatactcagtgtatccagcgtctatcagcctgaatagatcgaattcatctgcttacccactttctttcaagtcagaggaaaccttaaacaataatcctcctactgctgccaaacgtaccaataccttcccctcaattccaagcagtacgaaaaaacagaaaacaagccaagagaaacgaatctcttccatttcaaggagaaacacgcaagaaataattgctaagcaaattgcagaaaataacaaatctaaaaccatcgaggagtatgcgcagatcgtgaagcatgcagaaatcaaagtcctgagcatggactcacagaacacttcaaaggcagctttgcagctggcggaacaaaacagagaaagagaaagacaagtgtttgcgttactttggttaatgaaaaattgtaaatctcagcacgatagttacgtaccaagaggcaaaatatttgctcaatacgcttcatcttgttcccaaaacaacctgaagcccttatcacaggcgtcattagggaagttgataagaacagtttttcctgatttaacgactagaaggctgggtatgagaggtcaatccaaataccactactgcggattgaaactaactgtcaacgaaagcggctccgtgtcccttaataacaacaatgcttcgttatccttagtacacaataacgatcccatatcgcccctatcgtctccatcgccctcttcaccttcgccgcaggtacctaacgtttcatcgccgttctcattaaatagaaaaagtctttctcgaactgggtcgcccgttaaacagagtagtaatgacaaccctaacgaaccagaactcgaatcacagcatccaaacgaaacagaagcaaataaactagattcgctgccaccagcggcaaataaccctaccggaacactgtcttcagatgaattaactttcactcatgatttaattgaaaaagttttcaattgtaatgacaagctatcagataactataatacccaaatattatcgaacacagaacatccgcttttgacatcatataagttagacttcccaaaaattcccgcaggtgtactccccacagacactgattcggatgttatatcatccttggagtcattatatcatatccattgcaactccgtttatgaatgcatcaagtttctgaagagtgataatatatcaaatgcattattcttctctaactctaactctatatcgcccacgatgtttaatctattcatttctgagccattgattgattgggtaactaaatgtgacttaatcacctatacagggttaatcaaatttttttcacaatttataattcattctaatgagatcagtgactcaatcattcaaaaactggaaagtatgatcaagctattgcccgaacaaattaataaggctgttttagaattaccaaaagcgctagtgcaaaggaagttatcaattattaataattttaccaaactagtgaaaaaactaataaagttattaaaattcattctaaacttcttgaaaagttttcctatatttaaaagtggcatgaataatgactggaagaatattgtaaatttagacgatattttggaaatgatgattaatgaagacgatacaaattcagagacaaacacaataatgcaacatttacaagggttctgtcaagttttcgtaacaaagttcttaaattcctctatgagcgttagcaatgatccctctgtgtctatcgaatgcaagtccttaaatgaaatgattaaagatttttgttcctttatttccctacaaagcaaattttcgtgcttgaaattaattgattgcagcacaagattcaggaatgcaataatcggcgatattagcttaaaatcaaatgagaatttgctatcatggttgtttctaaataatgtcatgggccaattgctgaactactgttttgaagtcatgaaattcgtcaatggcctaaaagtttaa

SEQ ID NO: 538 - DNA, 1842 bp, Saccharomyces cerevisiae
atggctgaaggtgttttccaaggtgctatcggtatcgatttaggtacaacctactcttgtgttgctacttacgaatcctccgttgaaattattgccaacgaacaaggtaacagagtcaccccatctttcgttgctttcactccagaagaaagattgattggtgatgctgccaagaaccaagctgctttgaacccaagaaacactgtcttcgatgctaagcgtttgattggtagaagattcgacgacgaatctgttcaaaaggacatgaagacctggcctttcaaggttatcgacgtcgatggtaacccagtcatcgaagtccaatacttggaagaaaccaagactttctccccacaagaaatttccgctatggttttgaccaagatgaaggaaattgctgaagctaagattggtaagaaggttgaaaaggccgtcattactgtcccagcttactttaacgacgctcaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttccaccagaattccaaaggtccaaaagttgttgtctgacttctttgacggtaagcaattggaaaaatctattaacccagatgaagctgttgcttacggtgctgctgttcaaggtgctatcttgaccggccaatccacatctgacgaaaccaaggacttgttgttgttagatgttgctccattatctctaggtgttggtatgcaaggtgacatgttcggtatcgttgttccaagaaacactactgttccaaccatcaagagaagaacctttactacatgtgctgacaaccaaaccaccgttcaattcccagtctaccaaggtgaacgtgttaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctctaacgctgttggtagattgtcttctgaagaaattgaaaagatggttaaccaagctgaagagttcaaggctgccgatgaagcttttgccaagaagcacgaagctagacaaagattggaatcctacgttgcctccatcgaacaaactgtcactgacccagtcttgtcttctaaattgaagagaggttccaagtccaagattgaagctgctttgtccgatgctttggctgctttgcaaatcgaagacccatctgctgatgaattgagaaaggctgaagttggtttgaagagagttgtcaccaaggccatgtcttctcgttaa

SEQ ID NO: 539 - DNA, 558 bp, Saccharomyces cerevisiae
atggatgcattcagcttaaagaaggataatcgaaaaaaatttcaagataaacagaaattgaaaagaaaacatgccacacccagtgatagaaagtaccggctattgaaccgccaaaaagaagagaaagctaccacagaggagaaagatcaagaccaagaacagcccgccctgaagtcaaacgaggacaggtactatgaggacccggtactcgaggacccgcattctgcagtcgccaatgcagagttgaacaaggtgctaaaagacgtcctcaaaaatcggctccagcagaacgacgacgccacagccgtcaataatgttgctaataaagatactttgaaaatcaaagacctcaagcagatgaatacggatgagctcaatcgttggctcggacggcagaatacaacatcggctataacagcggctgagcccgaatcattagtcgttcccattcacgtacaaggtgatcatgatcgtgcgggcaagaagatcagtgccccttcgaccgatctaccggaagaactagagaccgatcaggatttccttgatggactgctctaa

SEQ ID NO: 540 - DNA, 2670 bp, Saccharomyces cerevisiae
atgccaacagctaagaggacgtcatccagggcttcgttggcactgcccttccagttacggttggtgcacaagaaatcatggggccatcggctaagagacttcatttccgggttcttaaaatcatgcagacccattgctaaatacgttttccccaacttcatcgtggtgcactatatctacctgatcacgctgtcgattatcgggtccattctgttatatccgtgcaagaacacggcgttcatcgatgtgctatttctggctgctggagcgtctacacagggcgggctggccaccaagagcactaacgatttcaacctgtaccagcagatagtggtgtacgtcattacattgctgtccacgcctatacttattcatgggtttttggcctttgtcaggctgtattggtttgaaaggtacttcgacaacattagggatatctccaaacagaattttaaactaagaaggaccatgacgttgcaacaaagggaactatcgggcagcagtggcaatgccgctcgaagtaggagtttcaaggacaacctgttccgtgggaagtttgtttccagagaagacccacgacaatccgcttcagatgtgccgatggactctcctgacacgtccgcattgtcctcaatctcaccgttgaatgtttcctcctctaaggaggaatccagtgacacgcaaagctcgcctccaaacttctcaagtaagcgccaaccctcagacgttgacccaagagacatttacaaatcgataatgatgctacaaaaacaacaagagaagagcaacgcaaactccacggattctttttcgagcgagaccaatggacccgctttcattgtgcaggaacgtcatgagagaagagccccccactgctcactgaaacgccattctgtcctgccatcttctcaggaattgaacaagctagcccagacgaaaagtttccagaaattgcttggcttgcggagagatgaaggtgaccatgactactttgacggtgctcctcacaaatatatggtcaccaagaagaaaaaaatatctagaacgcaatcatgtaacatcccaacgtatactgcttcaccgagtcctaaaacctcaggccaagtagttgaaaatcatagaaacttggccaagtcggcgccttcatcttttgttgatgaggagatgagcttttcaccgcaagagtctttgaatttacagttccaagcgcacccgcccaaaccaaaacgacgtgaaggtgatataggccaccccttcaccagaacaatgagcaccaactatctatcgtggcagccaacctttggcagaaactccgtcttcattggactcacaaagcaacaaaaggaggaactcggcggtgtcgaatatcgtgctttgagattgctgtgctgcattctcatggtatactacatcggattcaacattttggcgtttgtgaccatcgttccatgggcctgtacgaggcaccactactcagagattattagacgaaatggagtttctccaacctggtgggggtttttcactgcaatgagtgcattcagcaacttgggtctgtctttgaccgctgattcaatggtttcctttgatactgcgccgtatccgctgattttcatgatgttcttcatcatcataggcaatacaggcttcccaattatgttacgatttatcatttggatcatgttcaagacctcgagagacctatctcagtttaaggaaagtcttgggtttctcttggatcatccgcgcaggtgttttacgttgctgttccccagcggccccacatggtggctgtttacaactttagtcgtcttaaacgctacggattggattcttttcataattctggatttcaactccgctgtagtaaggcaggttgctaaaggttatcgagctctcatgggcctcttccagtctgtatgcacaagaactgctggattcaacgttgttgacttaagtaaattacacccgtccattcaggtgtcttatatgctaatgatgtacgtttcggtcctgccgctggcgatttccattagaagaacgaatgtttatgaggagcaatcgttgggactatacgatagtggacaagatgacgaaaatatcacccacgaagacgatataaaggaaacagaccatgatggcgaatccgaagagcgagacactgtatctacaaagtccaagccgaagaaacagtccccaaaatcgtttgttggtgctcatttgaggaggcaactctcttttgatttatggtacctattccttggattatttataatatgcatatgcgagggcagaaaaatcgaagacgttaataaacctgatttcaatgtctttgctatattgtttgaagttgttagcgcttatggtacagtgggtttgtcattgggttacccaaacaccaacacatcactatctgcccagttcaccgtattatcgaagctagtcataattgccatgctaataagaggaagaaatagaggtttaccatacactttggatcgtgccatcatgctgccaagtgacaaactggaacaaattgatcgtttacaagatatgaaagctaagggtaagttgttagccaaagttggtgaggatccaatgactacttacgtcaaaaagagatcccacaaactgaaaaaaatagcaacaaagttttgggggaagcattaa

SEQ ID NO: 541 - DNA, 630 bp, Saccharomyces cerevisiae
atgaacatatacacatcacccacgcgaacaccgaacatcgcaccaaagagtggccaaagaccatctcttcctatgctggccacagatgagaggtctacggacaaagaaagcccgaatgaagaccgtgaattcgtgccttgttcgagtttggacgtgcgcagaatctacccaaaaggcccattacttgttctcccggaaaagatctacctttattcagagcccacggtaaaagagcttttaccctttgatgtggtcatcaacgttgctgaagaggcaaacgatttacgaatgcaggttcctgctgtcgagtaccatcactaccgatgggaacatgattcgcagattgcgttggacttgccatcattgactagcatcatacacgcagctacgactaagcgagagaagatactgatacattgccaatgtgggctgtcgagatccgcaacgctgattattgcatatataatgaaatatcataacttgagtctgaggcactcatatgatctgttgaaatcaagggcagacaagataaacccttccatagggcttattttccagttgatggaatgggaggttgctcttaacgcgaagactaacgtgcaagccaacagttatagaaaagtaccgtga

SEQ ID NO: 542 - DNA, 1836 bp, Saccharomyces cerevisiae
atggcgcgtcaaaagcttactttcaaagaacaaatggatggtttcccctgggtccaacttgttgttgtgtccttagttaggttcagcgaaccaattgcgttttcgtcactatttccttatgtttatttcatggttagagattttaatattgctcccaatgatgctcaagtgtccaaatattcaggttatttatcttcatcatttgcgttatgccaagtcatatctgcgtaccactggggtagattctctgaaaaacatggcagaaaaataacattgacttgcgggcttataggaacatctgtatcattgttaatactgggattttcacacaatttctatcaggctttggtggcaagaagtttaatgggattgctaaatggtaacgtcggcgttattagaaccattattggtgaaatagcaactgaaagaaaacatcaggctttagctttcagtactatgcctttattatttcaatttggtgccgttgttgggcctatgatcggtgggtttcttgtatttagagatggaacaatgaatgaagtgccactatggtttccacattttgcaaaaagaataattaggtcatatccgtacgccttgccaaacgtggtagtgtgcatgtttttgatgtttggtttaactaatgcaacattgtttttggaagaaacacatcctgcttttaaaaatagaagagattacggtttagaggtcggtgattttattaagaagaatatatttggtatacagccgaaaagaagaccctggcaaaagcgcattcaggatgattcggaaaacattcaccaccgtaatgagaatgtgaacagcaatcgaggacaagatagtgaagaggatgaaaatagtcccctagtgaatactaccaatgacgatgatactgaaagcatacaatcgattgatcctattttaacaagaagacagtctgtaggcctgattaggacatattctctgcatgaaccaacagacgctgtgcatgccaatatagatacagctccagacggttgtaaagaaagtagtatatttcatcacgtttttcatacaaaagtattttaccctatatcggtgaattttattatggctttacatttgattgtatacaacgaatttttgcctgtttttttagcttatgatttagccgtagatccagaaaatccaaagaagctggcttcaaaatttccgtggaaaatatctggcggtataggttatgaaccagaacaaaccggtactcttttgtcgacaacaggtatctttggttgttttgtggttattttcatttttcccatagttgatcgaaatttcgattgtttaacaattttcagaactttagtcaagctgtaccctattatgtacgttatggttccttacgttgtttttctacagaatgaacggattcctagctggtatactgtcgtctacttgtacataatcacagggataaaaacattttgtggcgctttaacgtcaccacaaattatgttattaattcataattcgagtcccttgagttgtagatcagtcatcaatggcgccaccattagtatttctgcctctgctcgtttcataggtcccttagtatggggctatattatgtcttggtcccagcaaaatgacgtcgcctgggtcagttggtggtcgttaagtcttttttgtatggtagctctttatcaaagttataagatagcaccaattgatgataacgaaaatgagcttcatggacagggtagtgaagatgcctacaattcgcagtcacagtcttctgatttaagaatggctcatcgatctagtttaagcagcttaagtaaccaacgctgtaccacatga

SEQ ID NO: 543 - DNA, 858 bp, Saccharomyces cerevisiae
atgcgttcttcggtatatagtgagaacacttacaactgtatacgaacatcgaaggagcacctaacagaaagaaggagggtcgccatggcgccaatgttccaacatttcttaaacttatgcgtggaaaaatttcctgaatccatcgagcacaaggatacagatggaaacggtaacttcaccaccgctattttagaaagggagattatctacatccccgaagatgacactgacagtattgacagcgttgacagcctcaagtgtataaactacaagctgcacaaatctcgcggcgaccaagtgctggacgcctgtgtgcaattgatagacaagcacctgggcgccaagtatcgccgggcctcgcgcattatgtacggcaacaggaaaccatggaaggcaaacaaactcgcagagatgaaaagcgccggccttgtgtatgtctgttactgggacaacggcgtgctaggtgcatttacttcattcatgcttacagaggagacgggtctcgtcgaaggtgacgctttacacgaggttagcgtgcccgtgatatacctttacgaagtacatgtagctagcgcgcaccgcgggcatggaatcggtcggcggctactggagcatgcactgtgcgatggcgtagctcgacacacccgccgcatgtgcgacaatttcttcggtgtagcactcaccgtattcagtgataacactcgggcccggcgactatatgaggcgcttgggttctaccgcgctccgggatcacccgcaccagcatcacccacaattcgtcacacgcgacatggtgggggacgtgtagtcgtgccctgcgatccgctttattacgtatattgccttcacatgccgtga

SEQ ID NO: 544 - DNA, 1002 bp, Saccharomyces cerevisiae
atgagttgtgtgtatgcgtttgggtctaatgggcaaaggcaactgggactggggcacgatgaggatatggataccccacagaggtctgtgccaggagatgatggagcaatagtcaggaagatagcgtgcggtgggaaccacagcgtgatgctgacaaatgacgggaatctggtaggatgtggagataacagacggggagaactggatagtgcgcaagcactgcggcaggtgcatgactggaggcccgtggaagtaccggcacccgtggtggatgtggcgtgcggctgggacacgacagttattgtggatgctgatggccgtgtatggcagagaggaggcggttgctacgagttcactcagcaacatgtgccattgaattccaacgatgagcgcatcgcagtatacggatgtttccagaactttgtggtggtgcaaggcacccgagtatacggctggggcagcaacacaaagtgtcaattgcaagagcccaaatcccgatcactgaaagagcccgtattggtgtacgataccgggtctgtggccgtagactacgtggccatgggcaaggacttcatggtcatagtggacgagggcggccgcatagtgcacgcatccggtcgcctgcccactgggttcgagctcaaacaacagcaaaaaagacacaatctagtggtactgtgcatgtggacctcgatccacctgtggaatgcgcgcctcaatacggtagagtcgtttggtaggggcacacattcccaactcttcccgcaagagcgcctagacttccctattgtcggtgttgcaaccgggagtgagcacggtattctaactactgctaatcaagaaggcaagtctcactgttacaatgtatactgctggggctggggagagcatggcaactgcggcccgcaaaaggcgtcccagcctggactgcagctcgtgggccaatactctggaaaacctcgcgtgtttggcggatgtgccaccacgtggatcgtgctctag

SEQ ID NO: 545 - DNA, 2595 bp, Saccharomyces cerevisiae
atgataaattgcaaggtcatcgaaaacagaagaacaaggttttttcctttagtaaatgcaaaattagtaaaagtgatagcgtcttctttgattaacaagtttcaatctttgcctttggctatgtcaaagctattttctactgtcaattctgcaagacatagtgtaccactaggcggcatgagagattatgtgcacattaagaaactagagatgaatacagttcttgggcctgattcctggaatcaattaatgcctcagaaatgtctactaagcttagatatgggtacagattttagtaaatctgcggctacggatgatttgaaatattctctaaattatgcagttatttctcgtgatttgacgaatttcgtcagcaaaaaaaagaattggggttctgtttctaatttggctaaatctgtgtctcaatttgttatggacaaatattctggtgtcgagtgtctgaatttagaagtgcaggcggatacaacgcatattagaagtgaccacatatcttgtattattcaacaagaaagagggaatccagaatcacaggaatttgacgttgttaggatatctgagttaaaaatgttgactttgattggtgttttcacctttgagagacttaagaaacagtatgtaactttggatataaagttgccttggccaaagaaagccgaattgccaccgccagtgcaaagcataattgataacgttgtcaagtttgtggaggaatcaaatttcaagactgtggaagctcttgtagaatctgtgtcagctgttattgcccataacgagtattttcaaaagtttccagattcgcctttggtggtgaaggttttgaaattaaacgcaatcacagccacagaaggtgttggtgtaagctgtattagagagcccagggagattgcgatggtaaatattccatatctttcctccatacatgaatcgtctgatattaagttccaattgtcttcatcacaaaacactcctattgagggtaaaaatacatggaaaagagcgtttttagcgtttggttcaaacattggggaccgtttcaaacacattcaaatggcgttgcaattattatcaagggaaaaaacggttaaattacggaatatttcgtctatttttgaaagtgaaccaatgtatttcaaagatcaaacccctttcatgaatgggtgtgttgaggtggagacattactgaccccaagcgaattattaaaattgtgtaaaaaaattgaatatgaagagttgcaaagagtcaagcattttgataatggtccgagaacaatagatctggatattgttatgtttttgaatagcgccggagaagatattatagtaaatgaaccggatttgaatataccgcatcctagaatgctggagaggactttcgttcttgagccgttatgtgaattaatatcccccgttcaccttcatcctgtgacagcggaacccattgtagaccatttaaaacagttatacgacaaacagcatgatgaagataccttatggaaattagttccattgccttatcgtagtggtgtggagcctagatttttgaaattcaagaccgctacaaaacttgacgaatttactggagaaacaaacagaattactgtttcacctacatatatcatggctatcttcaacgctacaccagattcattttccgatggaggtgagcattttgcggacattgaaagtcaattgaatgatatcattaaattgtgtaaagacgcattatatttgcatgagagcgtcatcatcgacgttggagggtgttctaccaggcctaactctattcaggcgtctgaggaagaagaaatacgcaggtctatcccattaattaaggccattagagaaagcactgagttaccgcaagataaagtcatactatccattgatacttatcgttccaatgtcgctaaagaagcgattaaagttggagtggatattattaatgatatttcgggaggtttatttgacagcaacatgtttgccgtaattgcagagaacccagaaatttgttatattttatcacacacacgtggtgatatttcaacgatgaataggctggcgcattacgaaaattttgcattgggtgattctattcagcaagaatttgttcataataccgacattcagcagctagacgacttgaaagacaaaacagtgttaatcaggaatgttggtcaagaaattggcgaaaggtatatcaaagcgattgataatggagtaaagcgctggcaaattctaatcgaccctggacttggttttgctaagacctggaagcaaaacttacaaattattagacatatccccattttaaagaactactcattcaccatgaactcaaacaattcgcaagtgtatgttaacctcagaaatatgcccgttttattgggtccatcgcgcaaaaaattcattggacatatcacaaaagatgtggatgcgaagcaaagagactttgctactggagcggtggtagcgtcgtgtattggtttcggcagcgacatggttagggtccatgacgttaaaaattgttcgaagagcattaaattagcagatgctatttataaaggtttggaataa

SEQ ID NO: 546 - DNA, 2832 bp, Saccharomyces cerevisiae
atggatgcaggtttatcgaccatggcaacaagaaacggtcagtcttctgctagagttaaattgagaaataacctcttgaataatgatataggaaatattgacattagggatgaaacacctatttcaaggaacgggaatgacagcaatattaacatccagccttcttccgtgccgcagcagcagcagcagcagcagcaatactaccgtaatggcatgaatgaggctccaatacaagcgccacttcaacaacgtcaaattcccatgcagaattattcacaacagcaacgccagcaacaacagtataattttgagtattccaatccacatatgaatgagattcccctcatgcagcataacttcaccaaaccatcactaagcaataatcgcgataatgttaatggtaagaaagcttcctcatttacccagagctcattttccaattttttcaaacataagcatcaatttgggaagtcaaagaaaaacactaaggggacaggaggtggtggagatggtgatgatgacgatgaggttatcttggatgattctgcaaactccgacctaacattcaatgacattcagaccttcggtcacaagggcggtgacaaatatggatatggtggtgattccactcctatcattccaacattggtgactaaagaccgcggcaatatgagtaatactgagtataggaagtacattactaatcaaaggaaaaccgcaatgaatgccatggctaaacaaactaaaaatggtacattagcctcgttgcctccgagagcaatgtctttgcaaagtttcccgaatggtaatcctttaatgcaagcacccactcctcatcctagatttcaaccgaataaaatggtgagcgctaattattcgagatcaaattcgttgatgagtggacctcccggacaatttcgacagccgcagcaacaaagaatgctaccgatgaacaactacaacaatcacccaggtcaattccagaataccccaccagtaatgccctctggacaacagccacctcagcaaccacgtactctgtcattaactaatggcccaagatattcaccccaaaatcctcggccattcgcaggtcatcagcagatatcacaaagacaacaacaacaacaacaacaacttcaacttcatccaatgtctgaaggctatcggacaatgtctctacaaagtcagaacgttccccaagggtttaatccatggtcaccaaatgacaacgatcgtaaagctgtgtccatgaaacagccaatcagtcaatcgtcaatttcctcaaagaataattcagcttattcaataccgaacgtacaaaacaactccctgactacattctctccgtcatctcctactgatgctacagcaatgcctaactctacaaaacaaggatcttcaccactaaaaaaacaagtgaacattgatcaacctattgaaaacaagggaaaactgaatgttttgcaattatccactcctcaacaaaacgagttaaaggaaaaagaaaggaagctagctgaaatggaaaaatctttacgtgagagagaagcactagtagaagaaaaagaaaaggaaagagctgagaaaaatactgaagcaaatgaagaggaggaaatttcacatgaatcagacgatttaaatttaagacctgcgagtgcgctagagactggtttaaaagatcttaaattggaaagtgaaagtgcagtcgccaatagagcgtccttgtcgactttctcatccacatttagtgattctccctccaagcaaagaatcatcaataccagaacaggtatgtataagctagaaaactctactgatatcaatgaatacgtgaccgcacaagaattcccctctcccggaaagtataactcaaattcggataatggcgaaatgaatacaacgaacgaggtcgattttgatttcaatactagtaaaagggcttctttgttacaatccataccggaaagagatcccaaaagaaatgtctcagatgctaccattaagcgacgtgaatccgatggcaatggcaggagactaagtaatgtcaacatatccatgaaccaggaaaacatcaacaatgatacttttctatataaaaaaaataatcgcgatggtcatttatcagcagtttctcatatgtccagctcttcccgtagatcgttcatctccaatacgctgccgttgaatattgattccgcctcagaatctgataattttgtaccgcatatggatggttcaccctccaaaacaaaatcagccccagttagctacgataaggatggcatgaatgcttcagaagaagacttcagttttgataatactttagccaaaccgtatgaaccgttatatgctaggagaggagacataacttccgccggatcaactagtggagaagatagctctcagccaaagatgataacaatatctggtgagcaattgaatttgataacagaaaacaaagaattaatgaatgagttgacactggtgtctacagaattagcagaatcgataaaaagggaaactgaattagaagaaagaatacggctgtatgaaaccaataattcagcaccatcttttgacgattcttcgagtgtgtctttttctgactttgaaaaggaactgagaaaaaaatccagtaaaattgtgcaattgatccagcaattaaatgacgagagattaaagagattcattgcggaggagcagttattactccaagaaaatggcaccaaaccaagttctatggaactagtaggaagaattgaaaacttgaataaacttattgatgagagagattcagaaattgaaatgcttaaaggacgtttacagtag

SEQ ID NO: 547 - DNA, 2433 bp, Saccharomyces cerevisiae
atgaaaagaagaagcgatgctttgttgggaagtttccaggccaccaacgttacgccgccaagcgataatagtaatagtacggccggtggagccaatggaagtaactcaggaacaccaacttctactagcggtaagaagagaaacaagcttataaaatcttgtggcttttgcagaaggagaaaacttcgttgtgatcagcaaaaacctatgtgttctacatgcatttctagaaacttaacaacctgtcaatatgctgaagaattcaacaaaaacatcgaaaagaaagctacctatggtccctatcctaacgccgatttacttaagaaagttgaagaactagaaaacaaaatacgtattctagaagctgaaaaaaacactaattcgtctgcgagctccatgtacacttcgccaaatttccctcctttaggcactagtgtaggtagaggttctactgaaacttcatctccattacccgatggtgtaataaatccatatgccgaccggtactacctacaaagtaaacattccggaagatcaacactatacggccccacttctatgagaacccaaattgcaaatagtaattgggggttcattgaaaaatataaacaattatgggcgaaggttaaagtagaaagaaataaatggaagcaaaacaaccaaaaaacgatgtgcagggaactaggccttttggatgagtcggattggcagccagatccattaatcaaacagatatgtcgtttcctaccatcatataacaaagctttgtctattttagatgatttctttaatgatggagcatgcaatgagatcaacgtgattcttgataaggcaaaagttagaagagactttttagattatttcatgcccgaaaaagaggtaaaggcggaaggtgacagatccatagtttatattttatccaatccaaagaaaaattattacaaagctgctgtgatactattaatcctatgtctgaaatacttccatacagatgtcccaaccccaattgagaagttctttactttactaaagggggcctccaccgctaaggtgttctacattgagcgtgcacaaatgttaatacttttctactaccatcgtgaaacatattcattcggtggagatggctccgatttggttaatataaatgaatgtttagttactacggttactacaatagggttgcatttaaacattagagaaactttcaaggaacatgaggtttttatgggtagcatcgaaagtttagaaaatgtctggttaatggcaatatttatcgattataacatatcttgtaacgttggtagacccttattgattaacaaattttatctagacgaaaaccaagatcattgcatattgaatagtaaaagtaaaacatatgaggggaagctgaaaagatatttaaaacttacaaggccaatgttgttaactctttatgatagagataaattcccggatttgaaagcttattccaagcgaattatcaattttgtagaagaagaacttggtccacttggacattacacaggtgaaaatatatcggaagaagttccattaagggaaagtagaattttaagtatggcagtcggactattattgtcgttttatgcactaatacattctgtgctgaaagtcagaaacatagaatccaaaaataatacgtttcaattggttttgatcaatttttccatcattgtgaataccacaattcgatgctatcgtatcgacaaagcactttacccagagaaattcgaagcctccaacccgcacttaccgccacatatggcgttatcaatgagcctcacggcagggcttttttccaaaacattggtgtttttttgttctctgatctactttaagttgacgcttttcgaaaatggactatgtctatccaacgatatggaagttggatggtcggatttgacgaaattgactgttcctttagacaaggatctatctttaggtacagcaatgagcttgtactcgtcaatcttcgatcgcttgttcacggtcggaaataaagaattaatacgcacaatgcatagatcatcacaatttgtgatagagctagctattgaaaggacctataggactattcttggcaacgttattgaattcagaaagttgaccgaggaaacatggctagcacaaatcaaacaagaactagatccgcagagcgataatccatcatcagaagctaaaattgtgagtgataggcagcgggatctcagccttgcagttccaacgcccacgccctcaataattccaatgttaccctcgcctggtgaaactaagaaccatgcaaagagtcaatcagagatcattcagatgctgacagatgaattttgggcaaattataactcaggctgggaagagttgattaatcaatctgaattttccactcttttcgatgattacaaagacaattaa

SEQ ID NO: 548 - DNA, 2376 bp, Saccharomyces cerevisiae
atggtagcgacatcttcaaagaggacgttggatccgaaggaggaacatttgcctgctgacaaaacatccactaattcaagcaacactataatatctgagttggcaacacaagagaaatccagctctagtggtactacactaaaattaatagctcttaatatcaagtccatatcagatgaagatgtgggatatatccaaaatgttgaaagactgtctttaaggaaaaatcacttaacatccttaccagcgagtttcaagaggttatcaaggctgcaatatctggatttgcataataacaattttaaagaaatcccatatattttgacacaatgccctcaattagagatcttggatctgtcctccaatgagattgaagcattgccagatgaaatatcatcgttttggcaagataatattcgtgtattatcattgaaagacaacaacgttactagcatacgtaatttgaaatcgatcacaaaattaaacaagctgagcatcttggatttagaggataataaaatacccaaagaagagcttgaccaagtacagagttatactccatttcatacgggcatccccaaagaagaatattgggcaattgcgatatcacgatatctaaaagatcatcctaacctacctactccagaacctaaaatatctagagcagcgaaaagaatgggattcataaatacgaacttgtctaatggagcaatgaatgaaaacaatataatttcacttgccccaagtgcaaatacaactataagtgcatctactgcaatggtctcatctaatcaaacctctgcaacatctttcagtggtacagtcaatgcagaatcagaacaaagtggggcagtgaatggtacggaactatacaatcacaccaaatataatgactacttcaagaggttgtcgattttaccagaagagtcaatgagtaacgggcatcaaaaaatatcgcatgcagagttggttgtttcctgtcggaagctcctatttagttttacagaatgccaacaagctatcagaaaaatcgcctctttctgtaaagagaaggccgtagcggttaatgtagtatcattattatactctgtcagatcacatactgataatctggtggaggtcttgcagcaaacagagaacgaagacgaatcgcatgatcaggcgttaatcaagctgtgcctcactatcatcacaaattttaaacaaattataacattgttgagaaaaaattttgagatttttttcaaagaagacgatctatgcttcataaggatgttttatatgacattaatgtgtgcttatatggaaatgtataatgcatggtcttttatcaaagaagatgatcaagtgtccggttctgcaagtaaggcacccaagaaacattctttttcgaggcacgagacatcgtccagtagtatcacaagcggtggaggacccgcagcaagtacgaccagtacacattgtagcggaaacataaaattactgccgaaaacaaggagcacaagaacaccatctgcatctgcattgctttcaaatagtaatattctgacgggtgataccactgctgttcctcttttatcaccaaatctaaatggtgcacacacccatggtccaattttgggacaccaaaatgcaataagcaatggaagttctcaaacgaacatgaatgaagtaaaaactactagcgatactattccaaggcaacagctgcttcagcacaataaatccatcagcgattcgaaaaaagagtcacaggcgcatgaacctaaacagcatccggttatgacttcttcaataattaacgcatcaaatagtaataacgtctcgaatgttaatataaccccaccaccgatgaatggtggtggtgccgcgaacagtagtgctaatgtagtggagacaaatattgacattcaactgtatcaaacgttgtccacagtagttaaaatggtgagcgttgtatataaccagttaacttcagagatatccaagatagccattgctagcaccatgggaaagcaaattttgacggactcgctagcacctaaaattcgtgatttgacggaaacatgtcgtcaagcgatggatttatccaaacaattgaatgaaaggttaaatgtattaataccgaacgattcaaattcagagaagtatctgacatctttggagaagctgaaaacgtgggagataatgaattcgttcttaaaagtaataatatcaattctggctaatactaaaatcgtaatgagcgacgtgcctaatttgaatgagctgagacctaacctagccaacttggcgaagattaccaaggatgtcactgtgatattggacttgagttcatacaaggctgtatcagtaagcgccaactctccggagtaa

SEQ ID NO: 549 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 550 - DNA, 846 bp, Saccharomyces cerevisiae
atggcactacgatttttcaacgatatatctagagatgtcaatggcctattcaatagggacttttttcacaccaaccccctctctttgaatatttcaacaaccacggaaaatggtgtgaattttactctgaaggcgaagcagggcgtgacagaaggccccatccaaactagcgtagaaggacggttttatgacaggaaggagggagtgtcgctatctcagagttggtcgaaccagaacaggttaaatacaagaatcgaattttccaagatagcacctggttggaaaggtgatgtcaacgcatttttgactccccaatccatcaagaacgccaaatttaatttgagctacgcccaaaaatcgtttgcagcaagaacttctatagacatcttgcaacctaaggactttgtcggaagtgttactttgggccaccgcgggtttgttggcggcactgacatcgcatatgacacagctgcgggtttatgtgcacgctatgctatgtcaatcgggtatcttgccagagaatattcgtttattttgtctactaacaacaggcaatgcgcaactgcttcattttttcaaaacgttaaccgctatttgcaagtgggaactaaagccactttacaatcgaagacaagttctaatatgaacattgaatttgttaccagatacgtaccagattctatttcgcaagttaaggcaaaaattgcagattcaggcctgactacattgtcgtacaagcgaaatttgaataaagatatttctttgggtgtgggtatgtctttcaatgcgctacaactgactgaaccagtccacaaatttggctggtctctatcgttctcgccctga

SEQ ID NO: 551 - DNA, 1176 bp, Saccharomyces cerevisiae
atggacccacataatccaattgtccttgatcagggtactggtttcgtcaaaattggtcgtgctggcgagaatttcccagattacacgtttccttctattgttggtagacccatcttgagggcggaagaacgtgccagcgttgctacaccattaaaggacattatgattggtgatgaggcaagtgaagttcgctcttatctgcaaatatcttatcctatggaaaacggtattattaagaattggacagatatggaacttctttgggattacgcctttttcgagcaaatgaaactaccatccacctccaacggtaagattttactaacggaacctccaatgaatccgctgaaaaatagggaaaaaatgtgtgaggtaatgttcgaaaaatacgattttggcggagtttatgttgccatccaagctgttctagcattgtacgcacaaggtttgtcttcaggagtcgtcgtcgattccggtgacggtgttactcatatagtcccagtttacgaatctgtcgttttgagccacttaacaagaagattagatgttgcgggtagagacgttactaggcatttgattgatctgctttctcgtcgtggttatgcatttaacagaactgcagatttcgaaactgtgcgtcagataaaggaaaaattatgttatgtttcatatgatttagacctagatacaaaattggctagagaaacaaccgcccttgtggaatcgtatgagttaccagatggcaggacaatcaaagtgggacaagagagatttgaagcaccagaatgtttgttccaacctggtttggttgacgttgaacaacctggcgtgggcgagctgttatttaatactgtgcaatcggctgatgttgatatcagaagttccctgtataaggccattgttctttcaggtggttcaagtatgtacccagggctgccttcgagattagagaaagaattgaaacaattatggtttagtagagttttacacaatgacccttcaagacttgataaattcaaagttagaattgaagatcctccaaggagaaagcatatggttttcattggtggtgccgttttagctagtatcatggctgataaagaccacatgtggttgtctaagcaagaatggcaagaaagcgggccatctgcaatgactaaatttggtccaagatag

SEQ ID NO: 552 - DNA, 1587 bp, Saccharomyces cerevisiae
atgtctgctaaagttccatctaacgccacgtttaagaacaaggaaaaacctcaagaggttcgcaaagccaacatcatcgctgcacgttctgttgcagatgccatccgtacttcattgggtcccaagggtatggacaagatgattaagacatctcgtggagaaatcatcatctctaatgatggccacaccattctaaaacagatggccattctgcatccggtggccagaatgctagtagaggtttctgccgcgcaggactcggaagccggtgatggtaccacttctgtggtgatcttgaccggagctctattgggtgctgctgagaggctgttaaacaagggcatccatccaaccatcattgcggactcctttcaaagtgctgcgaagagatctgtcgatattcttttagaaatgtgccataaggtttcgttgagcgatagagaacagctggttcgtgctgcatccacttctttgagttccaagattgtgtctcaatactcttcgtttttggcgcccttggcagtggactccgtattgaagatatctgatgaaaactctaagaatgttgacctgaacgatatcagactggtcaaaaaagttggtggtaccattgatgacacagaaatgatagatggtgtggtcttgacacaaacggcaatcaaatctgctggtggtccgacaagaaaggaaaaagcaaagattgggttaattcaattccaaatatctcctccaaagcccgacacagaaaataatatcatcgttaatgactatagacaaatggataagatccttaaagaagaaagagcgtatttgctaaatatctgtaaaaaaattaaaaaggccaagtgtaacgtgctgttgattcagaaatccatcttgagagatgcggtaaatgatttggctcttcatttcttgtcaaaattgaacataatggtggtaaaggatatcgagagagaagaaatcgagtttctgtcgaagggcttgggttgtaagccaattgctgatatagaattgttcaccgaagatagattgggttccgctgatttagttgaggagatcgatagcgatggttccaagatagttagagtaactggtataagaaacaataatgcaagaccaaccgtctctgttgttattcgtggtgcaaacaacatgatcattgatgaaacagagcgttccctccatgatgcactatgtgttattcgttgtctagtgaaagagagaggtttaatcgctggtggtggtgctccagaaattgaaatatcccgtaggttgagtaaggaagcaaggtctatggaaggtgtacaggcttttatttggcaagaatttgcctctgctttggaagttattccaacgactttggctgaaaacgcaggtttgaatagtatcaaagttgtcacagaattgcgctctaagcatgaaaatggtgaattgaatgacggtatctctgttagacgatctggtactacgaacacctatgaagaacacatcttacaacccgtacttgttagtacaagtgcaattaccttagcgtctgaatgtgttaaatccatcttacgtattgatgatattgcattcagccgttaa

SEQ ID NO: 553 - DNA, 630 bp, Saccharomyces cerevisiae
atgatatcaccatcaaaaaagagaaccattttatcaagcaagaatataaaccaaaaaccacgagcagtggtaaaaggcaatgaacttcgttcaccatcaaagagaaggtcacaaatagacacagactatgcactaaggcgaagtccaataaagacaatccaaatttctaaagctgcacaatttatgctgtatgaggaaacggctgaagaaagaaacatagctgtccacagacataatgaaatatacaataataacaattctgtgagcaatgagaataatccttcccaagtaaaagaaaacctttcacccgctaaaatttgcccttatgaaagagcatttttaagggaaggaggaagaattgcattgaaggacttaagtgttgacgaattcaaaggttacatacaggatcctctcaccgatgagactataccactgacgttgccactgggtgataaaaaaatcagcctacccagttttataacgccgccaagaaattcgaagatatctattttcttcactagtaaacaccaaggacagaacccagagacaaagatatcccgttctaccgatgacgtcagtgaaaaaaaagtagtgagaaaactgtccttccacgtctatgaagatgagtaa

SEQ ID NO: 554 - DNA, 1671 bp, Saccharomyces cerevisiae
atggaaagagtatggtttgcaaaattaacaaataaaggaactattaaaatcgggtatatctcatttatacttctaagtttgctatgtcaatctctgattgggctggttaatgctgattttaattatgaaggctgttacagtgccgcggatatccagtctgctggactgtctctgaaaaactcatacatatatcaatcagtgtcatactgtcaaaaccagtgccctgagtcagcagtagtagcattatttaacgggtcagattgttactgcggtaattcggtaagttttctgacttctttgacgaaatcaacagattcaaactgtggaactaaatgctctggctggccttaccaaatgtgtggagggtcatcgtacatgaacgtgtatgtaaatgctgaaacttttgtttcatcggttgaatcttcctcttccaaagaagggtctagcacttcctatatgccctcaacaacttcttcattgtcctccgcccaaatttcttcaactactaggagaacgtcaacagatatgaaaagttctgaaatgatagccacgacagtttctaccacttcaacaacctcttcctcgacttcctctactacctcttctaccacctcttctaccacctcttctaccacctcttctactacctcttcctcgacttcctctactacctcttctaccacctcttctaccacctcttctaccacctcttctaccacctcttctactacctcttctactacctcctctactacctcctctactacctctatcttttctgttacgtctagctcctcatccattacattgtcctcatctgagcataccacagtcgatagccgtacttcttcaccctcttccaccttggtgccagtgtcctcgagtagcagcacactatcaactccaaaagtgacctcaatgacccctagtacgtcatcaacgataccaatagttacctcagtggaactagtgactagtgtggttacaaaagcgatcgtgagtacttctgatcaacatcaggaaacaatatttgttacgaggacatccgtggttgaacgatcttctgaggtagctactgctactgctgccgcctcaaataatagatctaattcgacttcgaagcagcgtctgagtggtggagccattgccggtattgttattggtgttgtgtttggcgtaatttttattattttgattctattgttcctgatatggaggagacggaaatcgcacgaccaattagacttggaggaaacgaaacattatcagccctattcgttcggtgatgaggatgcaaatccaataggaccgcctccctcctctggtacgacaaattggatgagacattcaaggggtaatacagcgggttctatcggtacaagtaatatgtatggtttttctatgagtaatggtgcaaattatagtagtcctagttcaaacaccagtggaagcatcataaacaacttggctggcttacaagatgctacggttcagaaacagaaccttccatcgacagtttttgaagaggcaaatactttgaatagtgcaaatgaaaggttcagtgccaattctttacccgacatgatgatgagcggaccattgcaagtggtaaaccctgataatcctgataatcctgaattatctagtaccgtatctcataatcgagcctga

SEQ ID NO: 555 - DNA, 981 bp, Saccharomyces cerevisiae
atgtccactgatagtacacgctatccaattcagattgagaaagcctcgaatgatccaacccttctgcttaatcacacatgtttaagagtcaaggatccagcaaggaccgttaagttctacaccgaacacttcggtatgaagctattaagcagaaaggattttgaagaagcaaaatttagcttgtactttttaagctttccaaaagacgacatacccaaaaataagaatggagagcctgatgtttttagcgcacacggtgtcttagaactaactcacaattggggtactgaaaaaaacccagactacaagatcaacaacgggaatgaggaacctcatcgtggatttgggcacatctgtttttctgtatccgatatcaataaaacctgcgaagagctagaatctcagggtgtcaaattcaagaagagactctctgaaggaagacagaaggacattgcgtttgctttaggccctgatggatactggattgagttgatcacatattctagagagggtcaggaatacccaaagggctcagtaggtaacaagttcaatcataccatgattcgtattaaaaacccaacccggtctttagaattctaccagaatgtgttgggcatgaaattattaagaactagtgagcacgaaagtgcaaaatttacgttatactttcttggttatggcgttccaaagaccgacagcgttttttcatgtgaaagtgtgttggagttaactcataattggggaactgagaatgatccaaacttccactatcataacggtaactcagagccccagggttatggtcacatctgcataagttgtgatgacgctggcgccctttgtaaagaaattgaagtgaaatacggcgataagatccaatggtctcctaaatttaaccaaggcagaatgaagaatattgcctttttgaaggatcctgatggttattccattgaagtcgttcctcatggtttgattgcctaa

SEQ ID NO: 556 - DNA, 2862 bp, Saccharomyces cerevisiae
atgaatagtactaatagtactaatagtactacaacagctaccagtacaaacacgtcaactcaacaagtcgttacttctttggtaagtaatggtactatttttggtgtttttgtcatagcgttcttgattttgcgtataaaactaaaaaggatttatgagcccaaatcctcattcaatctgattaatgaagaaaaaaagccagaaccgctaccgcagggcgtctggcaatggctgaagccgttattgaaaaaatcagacaattttgtcattcaacaagccggtctggatggatatttctttttgaggtaccttttcatcattgcaatttactgtgctgtttccatgagttatatattccctattttgttgtccattaacgccagtaacggtaaccatgaaagcggattgaatcaattggcctatcagaacgtcaagcaccgtggtagatattttgcacatgttttctgtggatggattttcttttgggggttcctttacattatttacagagaattgtatttttacacctctatgaagcaagctgtactagcgtcccctcgttatgctaaaaaactatcctcgagaaccgtgttattccagactgtccctaagcaatacttaagtgaagaagagttttctaagttgtttgatggtgtgaaaagagtctggatcgcaagaggttccggttcaattgaagcaatggtcaaagcaagggacaatatggccatacaattggaaggtgctgaaacaaaatacctgaaagcagcattgaaaaaaattaagaagttaaacaaaaaaagtccgcaattatctgtctctgataatattgctgaatatgtccctgacaagaaaagaccacatcataaaattaacaaggttgctaaattcttttttggtaaaaaagttgacaccatatcctacattaaggaggagttgcccaagttaaaccaaaaggtgaaggcattacaagaagatcatgaaaattcatcccctttcaactccgtttttgtggagtttgaatcccaatatcaggcccaagttgccgctcagatcaccacataccatgctcctcttttcatgacgcctgtgtatattggtattgagccatccgatgtcgtttggtttaatttgaggatgttctggtgggaaagattaggtagggaagtcagtgcggtttcagcaattgtcgcgctagtaatattatgggctttcccagtggcttttgttggtatgatctctaatattacttccttgactaatgaagttaaatggttaaagttcatctataaattaccaaaacaactattaggtttactgacatctctggccccaactgtggcattggccgttttaatgagtttcttgccgaaatttattaggggtatggctatcactcaaggtgctccatctaagcaaaatgtggaatatttcactcaacaagcttatttcgcctttcaagttatccaagtctttttagttaccactctatcctccgccgccacttccacagtaacggaaattgttaaagagcccacgaaggctatggatctactggcttctaatctgccaaaagcttctaattttttcatgtcatacgttattctacaaggtctgtccatttcatcaggtgctcttttgcaaattgttccactaatactcttttatgttttaggtgcctttttagatggtaccgttaggaagaaatggaatcgtttttgtgggctatccagtatgcagtgggggacagcttttccagtttatacaaacttggcagttattactttctcctactccatcatttctccgttgattttattatttgctgccgtcgcgtttttcctattgtatattgcatatttatacaatttgacttatgtctatcaggaatcacccgacgcaaggggtatttattatccaagagctcttttccaaactatagttggtatctacatcggtcagatatgtctattaggtctttttgccgttggtaaaggttggggcccaatcgttttacaggtaattggaatttgtgttaccgtccttattcatttacatttgagcgctgcatttgatcatttatcaaaggttatacccgttgataccatgaaaccgttagatggtgtatcagatacaccttctttcaaaaatatttataaaggcatagaaagtacaaaggtgaagaaaaatacttttggtgcaaatattgacatggacggaatcaaagaattacctgaatttccaataaagaaatatcacaagaggagtgaatcagtcactgagcaacaagttgaaaatagcatatttagtgaaaatacattcgaatatcaattcaacccagcaaatgaagccaatgcagatgggcacgctataaatgcagaaaatttaattgaggacgtgccattattagcagatggtgatacaatgaaaattcctccggctccatggtggaagagattcttaaaacctcacatttactactcctataaggctgtaaagagcagactgccagaaatatatggtttggttgatcctgatgaaagagtcaatgatttcgatatctctcatgcttacgattatccagctgttagtgcacaatgccccgaattgtggattcctcgcgatccttttggattttccaaattgttgatttcagacgtttctggcgttgttgaaatgaacgatgaaaatgctaccatcgatgagaatttgaaatttactctgcgtgacgtaccaccaccatataatgatgttaaagacgaagcaaatggtgaagcaaatggcgaatttgacacagctagtaaggaaaataatccatttgcggacccaaagtataaggaagaagagagtcgttcggcagtctaa

SEQ ID NO: 557 - DNA, 1839 bp, Saccharomyces cerevisiae
atgtcatttaaggcaactatcaccgagtcggggaagcagaatatctggtttcgtgcgatatatgtgttatctacaattcaggatgatatcaagattacagtgacaacaaatgagttaattgcttggtcaatgaacgagacagatactactctttgtcaggttaggtttcagaaaagcttttttgaggagtatgagtttaaaccacatgagattgtatttggagaaaatggggttcaagttatagaagatacgtacggcaatagtcataagttatactccttccgtgttaatggaagacacctaacaactatatcaagaaagccggatggtgatggcatcaaatcattcacaattgcggtaaacaacacttctacctgtcctgaatcacttgcaaatagattgattgtggtgattgaaatggattcgttaatagtcaaagaatactgtccccaattccagccaataaaatacgatcccataataatcaaccttaagtacaaaaggaggtttttggatgtttttggaactgctgcctccgatcggaatccacaggagcccttggaccctaagctattggacgtttttacaaatacagagcgtgagctaacatcagccttatttaacgaagaagtggaatcagacatacgtaaaaggaatcagttaacggctgctgatgagattaattacatttgttgtaattcaactttattgaagaattttttagacaactgcaatgttaatgtaaccgatgaagtaaaattggaaattaacgtacataggctaagcataactgcattcaccaaggccgtctacggcaaaaataacgaccttttaagaaatgcgttaagcatgagtaacactatcagtacgctcgatcttgagcattattgcttatttacaacaatcgaagatgaaaaacaagataagcgatcacatagtaagcgtagagagcatatgaaaagtataatattcaaattgaaggacttcaaaaacttcataacgataggtccatcctggaagactacccaggacggaaatgataatataagtttatggttttgccacccaggggaccctattcttatgcaaatgcaaaaaccgggcgtaaaattagaattggttgaagttactgacagtaacattaacgatgatattttagaaggaaaattcataaaaacagcaatctctggctccaaagaagaggccggactgaaagacaacaaagaaagctgcgaaagtccattaaaaagcaaaactgctttaaagagagaaaacctgccacactctgtggctggaactcgaaacagtcctttgaaagtgtcgtatctgacccctgataatggaagcacagttgctaagacctatagaaataacacggcaagaaaattattcgtggaagaacaaagccaaagtacgaattacgaacaagataagcggttccggcaggctagttcagttcatatgaacatgaatcgggaacaaagttttgacattggtacgactcatgaagtggcctgtccacgtaatgagagcaattctttaaaaagatccatagcagatatttgtaatgaaactgaagaccccacccaacaatctacatttgcaaaaagggcagacaccactgtgacatggggaaaagcgttaccagctgcagatgatgaggtttcatgcagcaatatcgatagaaaaggaatgctcaagaaagaaaaattgaagcatatgcaaggtctgttgaattcccagaatgacacaagtaatcacaagaaacaggacaataaagagatggaagatgggctgggtctaacacaagtagaaaagccaaggggtatatttgactaa

SEQ ID NO: 558 - DNA, 771 bp, Saccharomyces cerevisiae
atgtttaatttaattttatggcccttatttttgcttacctcagttgccattcctttgcagctgacattagaagtggtctatctgacgtcttccgttgacttctcaaaggcaagtgctgctaaaaccgctacttctttgggtcagtccccagttgtcatcaccatttataaatcactgttaaaatattggagtctttacgagttcatacattttatttacctctatactcctattgatgcctttctgaatttcttaccatttacctctttacttatgtcgtttggaagtatttgcttgacaagagagctggtatatgacttcattgcctttatggaatctcaaaacaagcttaccggattccttaataagataacagaaccgaattttaacagttatttactgttttcttcaatttataacatttggtttgcagatgacaccaatgacaaattcttattcggtaaattaactcagattttaatatctgtaacaaaaaggtacgaatttccaagaacattctacttagcaaaagtttctgatttcctacaaaatctcattctaacgagattgagaccctttgtaacggagcaaccccaaggcgacaaaaatcgctatcaaaacggtgaccgtgaatctacaaagaatggagctgcttatcagaagtcttcacaacaatcatcgtctttcgaacaaaattttaccagcactgagttcccgaatgattatgattttatggaggatattctagatgagacaactgaattggattag

SEQ ID NO: 559 - DNA, 1650 bp, Saccharomyces cerevisiae
atgactgtgcactcaacgtggaaggaaaaagttcaattaaaaaaagatcaactgaacagtaagataaaagacgaatggaaattaaacagcacaactataacgaggttgaagaacgataaaaaaaatttaatcaagaatatcgatgatttatgctcatcttcagaaaatcagatcacccactccacgattatggccttgagacaggcactggaagcaaaagagttaagctgccatgaaataacagctgcattttgtcatagggctgctttaattcatcaagtagtgaattgtctatccgaaatcatgttttcagaggcattgagattggctgactattacgacagcaatagaccagccatattgccacccttgtacggtataccgatatctctcaaagaccaatgtaacgttgagggtgtagacacctcactgggttatttatgtcgaactttcaaaccaaaaaccaagaatgaagaatcattgattgtcagttttctgagagatttaggagctattatatttgtaaaaaccaccgtaccttcatcgatgatggctacagatacacaatctaacacctttgggtacacatataatagtattaatttaagcttctccagtggtggatcttctggtggagagggttcgttaattggtgctcatggttccttgctgggactaggaactgatataggcggaagcatcagaattcctagtagttaccaaggattatttggtttgaaaccaacttttggacgcgtcccttacttgagggtggataattcatttgagggaagggaaacaattcccagtgtaattgggccgttggcaagagatctttcggatttgagatacttcatgagttgcgttatcaacatctgtcaaccatgggtacaagacgtcaagtgtattccataccattttgattcctctacaagtaaattacacgataattatgttgttggaatatggtatggtgacggcgttattgatcctccgcccagtgacatcagggctttaaagacgtgcgaagacctagttaataaaactaaaggaatgaaggcagttaaatgggagccttccagtgaactgagcagggaattgtttgatctcgcaaatgaagcagatgttgctgactcaggtaacgagataaaaaacgaattcgaaatttccggagaaccactcctagatattttaaaaccaatggttttggaaaacggaaggcccccatatactgttaatgaatggtgggatttgaccaaaagagtttataatgcacaacaattaatgagagattattacctttctttcccggaatcagaaaggcctgatgttatcatatctcctacaacgctgatgccatttaggcctggtgacatgctaaagacaactttacgatacattttactattcaacgttttaaatttcccatcattatctatacctgtaggtagtgtcgattgccaaattgatgggctaatggataccacttctgcgctcaatccagaagataaaatgatcaaaacatattggaatgatttaatacaatctggtgagatagatgggtttccaataggcctacaagtagttagcccgactttcaatgacaatgaagtttgtaaatttgcgtcttggctttttagcaaaatatag

SEQ ID NO: 560 - DNA, 1941 bp, Saccharomyces cerevisiae
atgagttacgaatctgggaggtcatcctcctcttccgagagtacacggccaccaacgctaaaagaagaacctaatggtaaaatagcttgggaagaaagtgtcaaaaaatctagggaaaataacgaaaatgacagcactctcttgaggcgaaagctaggtgagactcgaaaagcaattgaaactggaggatcatcgagaaataaactttctgctttgacacccttgaaaaaagtggttgacgagaggaaggattcggtacaaccacaggtcccttccatgggttttacttattctttgcctaatttgaagactttaaacagtttttcagatgctgagcaagcacgtataatgcaagattatctatccaggggggtaaatcaaggcaacagtaataattatgtagacccactatatcggcaattaaatccaactatgggtagtagcaggaacaggcctgtttggagtttaaatcagccgttaccgcatgtattggatcgaggcttggcagcaaagatgatacaaaagaatatggatgcaaggtcccgcgcatcatcgagacgagggtcgaccgatatttcaagggggggttctactacgtcagtgaaagactggaaaaggctccttagaggtgcagcaccgggtaaaaagcttggtgacatcgaagctcaaacgcaacgcgataatactgttggtgcagatgtgaaacctactaagttagagcctgaaaacccacaaaagccctctaacacgcatattgagaatgtttcacgtaagaaaaagcgtacttcgcataatgtcaatttttcattaggcgatgaaagctacgcatcctccatagccgatgcagaatccagaaaattaaagaacatgcaaaccctcgatggttctactccggtttatacgaagcttcctgaagaacttattgaagaggaaaataaaagtacgagtgcattagatggtaatgaaattggtgcctcagaagatgaagacgcggatataatgacatttcctaacttttgggcaaaaattcgctatcatatgcgagaaccgtttgcggagtttctcgggacactagttcttgtcatttttggtgttggtggtaatcttcaagcaactgtaacaaaaggtagtggtggttcctatgaatccctatcatttgcatgggggttcggttgtatgcttggtgtttacgtcgcaggcggtattagtggtggtcatattaaccctgctgttacgatttcaatggcaatttttcgaaaattcccctggaaaaaggtgcccgtatatattgttgctcagattatcggtgcatattttggaggagctatggcttatggttatttttggagctctatcacagaatttgagggaggtccgcacataagaacaacggcgaccggtgcgtgtttgtttactgatccaaagtcttacgtcacgtggagaaatgccttctttgacgaattcataggagcctctatacttgtgggttgtttgatggcgctattggatgatagtaatgctccacctggcaatggtatgaccgcattaattattggattcttagtcgctgcaattggtatggcccttggatatcaaacaagtttcacaatcaatcctgcaagagatctcggtcctcgcatatttgcttccatgattggctatggtccacatgcttttcatctcacacattggtggtggacatggggagcctggggtggtccaattgccggcggtattgctggagcactcatatatgacattttcatttttactggatgcgaatccccagtcaactacccagacaacggttatattgagaatagggtaggtaaacttttacatgcggagttccaccagaatgatggcactgtctcagatgaatctggtgttaacagcaacagcaacactggcagcaagaaatctgtgcctacttcgtcataa

SEQ ID NO: 561 - DNA, 486 bp, Saccharomyces cerevisiae
atgccacaagtacagtcgtggtttcctgttcagaaacaaccgacgctagcggtaacatttacaccattaccacaactgtcccatgctcatctaccactgccaccatcacatcttgtgacgaaaacggatgccatgttccagcaccaactgctaccgacgcaactgcaaccgtttcctccaagtcatacaccactgttactgttactcactgtgacaacaatggctgtaacaccaagactgtcacttctgaatgttctaaagaaactgcagcaaccaccatttctccaaaatcatacactactgttaccgttactcactgtgacgacaacggctgtaacaccaagactgtcacttccgaggcttccaaacaaacatcattggccactagcacagtcaccaagtctgctgctccaacttctcatactgctgcttccagcaccttcactggtattgtcgttcaatccgaaggtatggctgctggtttga

SEQ ID NO: 562 - DNA, 3483 bp, Saccharomyces cerevisiae
atggtactgacgatttatcctgacgaactcgtacaaatagtgtctgataaaattgcttcaaataagggaaaaatcactttgaatcagctgtgggatatatctggtaaatattttgatttgtctgataaaaaagttaaacagttcgtgctttcatgcgtgatattgaaaaaggacattgaggtgtattgtgatggtgctataacaactaaaaatgtgactgatattataggcgacgctaatcattcatactcggttgggattactgaggacagcctatggacattattaacgggatacacaaaaaaggagtcaactattggaaattctgcatttgaactacttctcgaagttgccaaatcaggagaaaaagggatcaatactatggatttggcgcaggtaactgggcaagatcctagaagtgtgactggacgtatcaagaaaataaaccacctgttaacaagttcacaactgatttataagggacacgtcgtgaagcaattgaagctaaaaaaattcagccatgacggggtggatagtaatccctatattaatattagggatcatttagcaacaatagttgaggtggtaaaacgatcaaaaaatggtattcgccagataattgatttaaagcgtgaattgaaatttgacaaagagaaaagactttctaaagcttttattgcagctattgcatggttagatgaaaaggagtacttaaagaaagtgcttgtagtatcacccaagaatcctgccattaaaatcagatgtgtaaaatacgtgaaagatattccagactctaaaggctcgccttcatttgagtatgatagcaatagcgcggatgaagattctgtatcagatagcaaggcagctttcgaagatgaagacttagtcgaaggtttagataatttcaatgcgactgatttattacaaaatcaaggccttgttatggaagagaaagaggatgctgtaaagaatgaagttcttcttaatcgattttatccacttcaaaatcagacttatgacattgcagataagtctggccttaaaggaatttcaactatggatgttgtaaatcgaattaccggaaaagaatttcagcgagcttttaccaaatcaagcgaatattatttagaaagtgtggataagcaaaaagaaaatacaggggggtataggctttttcgcatatacgattttgagggaaagaagaagttttttaggctgttcacagctcagaactttcaaaagttaacaaatgcggaagacgaaatatccgttccaaaagggtttgatgagctaggcaaatctcgtaccgatttgaaaactctcaacgaggataatttcgtcgcactcaacaacactgttagatttacaacggacagcgatggacaggatatattcttctggcacggtgaattaaaaattcccccaaactcaaaaaaaactccgaataaaaacaaacggaagaggcaggttaaaaacagtactaatgcttctgttgcaggaaacatttcgaatcccaaaaggattaagctagagcagcatgtcagcactgcacaggagccgaaatctgctgaagatagtccaagttcaaacggaggcactgttgtcaaaggcaaggtggttaacttcggcggcttttctgcccgctctttgcgttcactacagagacagagagccattttgaaagttatgaatacgattggtggggtagcatacctgagagaacaattttacgaaagcgtttctaaatatatgggctccacaacgacattagataaaaagactgtccgtggtgatgttgatttgatggtagaaagcgaaaaattaggagccagaacagagcctgtatcaggaagaaaaattatttttttgcccactgttggagaggacgctatccaaaggtacatcctgaaagaaaaagatagtaaaaaagcaacctttactgatgttatacatgatacggaaatatacttctttgaccaaacggaaaaaaataggtttcacagaggaaagaaatcagttgaaagaattcgtaagtttcagaaccgccaaaagaatgctaagatcaaagcttcagatgacgctatctctaagaagagtacgtcggtcaacgtatcagatggaaagatcaaaaggagagacaaaaaagtgtctgctggtaggacaacggtggtcgtggaaaatactaaagaagacaaaactgtctatcatgcaggcactaaagatggtgttcaggctttaatcagagctgttgtagttactaaaagtattaaaaatgaaataatgtgggacaaaataacaaaattatttcctaataattctttagataacctaaaaaagaaatggacggcacggcgagtaagaatgggtcatagtggttggagggcatatgtcgataagtggaaaaaaatgctcgttctagccattaaaagtgaaaagatttcactgagggatgttgaagaactagatcttatcaaattgcttgatatttggacctcttttgatgaaaaggaaataaaaaggccgctctttctttataagaactacgaagagaatagaaaaaaatttactctggtacgtgatgacacacttacacattctggcaacgatctggccatgtcttctatgattcaaagagagatctcttctttaaaaaaaacttacactagaaagatttccgcttctactaaggacttatcgaagagtcaaagcgacgattatattcgcacagtgatccggtccatattaatagaaagtccttcgaccactagaaatgaaatagaggcgttgaagaacgttggaaacgaatcaatagataacgtcatcatggatatggctaaggaaaagcaaatttatctccatggctcaaaacttgaatgtactgatactttaccagacattttggaaaatagaggaaattataaagattttggtgtagcttttcagtatagatgtaaggttaatgaattattggaggccggaaacgctattgttatcaatcaagagccgtccgatatatcctcttgggttttaattgatttgatttcgggagagctattgaatatggatgtaattccaatggtgagaaatgttcgacctttaacgtatacttcaaggagatttgaaatacgaacattaactccccctctgattatatatgccaattctcagacaaaattgaatacagcaaggaagtctgctgtcaaagttccactgggcaaaccattttctcgtttatgggtgaatggatctggttccattaggccaaacatatggaagcaggtagttactatggtcgttaacgaaataatatttcatccagggataacattgagtagattgcaatctaggtgtcgtgaagtactttcgcttcatgaaatatcagaaatatgcaaatggctcctagaaagacaagtattaataactactgattttgatggctattgggtcaatcataattggtattctatatatgaatctacataa

SEQ ID NO: 563 - DNA, 7887 bp, Saccharomyces cerevisiae
atgatgtttccgattaatgttctactgtacaagtggcttatatttgcagtgactttcttatggagctgtaaaattttactaaggaagcttttaggaataaatataacatggattaacctgtttaaactagaaatatgcggtttatccttagaagatggtaccgtcaggctaaaatccgttcgttttgctgtatttgaaagaaagcttttcatcaagggtctacgaattgattccaagaaatcatctactaatgatcttcataaagaattaccaagagaggaagaaagaacttttatagagacccccgaagataatggtgggggcttcatttctaagattctttcattatcacaatactggctcaatggggtcacgatcattttggaagatacgcaattagtcaacaacgatatcacgattgaaaaatttggcttttttctttcaattgataactctaaacatatcaagtcactaagatttgattcctttttgagaaaacttctttggaatggccagaccatcattgctgatgccatttttatagtgaatacaaacttactaattggtgaaattatgaatcctctgaaggatggacttcaagtaggattagatttaaaactaggtgatttaaatattcccatgaatttattgaatttatttatcaacaaggagaacgttgatttgatgtccaatgaaaaacttctacaaagattggcagatacaacaaaggcgaatgaagagctaaaggatgaagatatcgctaagatgaaggatgatctcgtgtatgcaatggaaaaatttgtagatcggataaagccattgaaagaaatgaacgtcaccgttgataaacttcaaatcaaagattttccactcaccaatcatccagaactgcttggaatgaacaaatatatcagttataatgttttggtttctaatataaacttcaataccaacaggttcagaaatgagatgccaggttatacgttaatttttgaggagcgtgattctcccttcaagtttagtattataatggcaagatttaatatatatttgaatctaaatcgaaaacatcaaagccacgccaaacagttgaaaattattgaaattccaaatgtttcgatatttggcgaaaccaatttgttctctcaaaaatttcgtctttctaataacctacacgcaaaggaactagagaacgctatttttaacatcaaaggtaatatatcctccttaactattgacatggatccagtaaatatttcctttatcaaatgcttcctatcaaacattaaagtctttacgtcctcttgtccgaaaaacaagattttaaaggagaattctcatgtaaagttcttaacaaggcggagagtcctatttgactattttaagtgttttttgcctctaatcaatatgaaattcaccctggatgatcccaaatttgttatcaatgataaagacgatctgatcataggcaagttttctgtcttcatgataagccatcactctaaaagatatacattgggtaacaatcttatggaagaaaaagaagagacgcaacacattttttatgaaagccattggaatgttgaattactagatatgaaattacagcatattataaaacatcaaaaatacgagcatacaatattaagggtggacagcattgccatagaagaaaaagttcaacttttaccggatatattatgttctgcaaacgctgatatcgacacgctaatgctagatttatctgaacttccaacaatggttatgttgagtgaattagtacacaacttagatagtcagttggcaaatgtcgaagagaattatttcaaagagttctatgaaaagttcgcatctaatttacaaaatatgaaagctgaatgttctaatatggctaaatgtttgagacagaaggaaattttaccaagcgacttcatgttccagcaactacctgattttttcgattatattaaaatcaatattagagacatatcatccaccctaggtgctaggtcggtttttatgccaagagatgttttctcttccgttgactctcaaagttcaaaggacctaattgatggcaaactaagaaaatactgcaatacagtcgaaaaattgcaaattgctttatttggtgacaagacacaatggcataacaaaattggctcaaatcacgctactatggttaggtctggtcagctcacaaattttagtaaagataataaacagaatcctaaccataagtccagtattgccgatttagacgatatatcgactagtgatgcgacagaggtaaatcatctttggaacatcaacttactagtaaatgatataactacgtcaataatcggagagacacccgaagtgagcgaagaattgtccactaaaactgtttccaaagtttctaatttatcaattaagctatttccagacactgagtcatttagtagcaatgaaagcgattcgaagataattttgcaaataaatcactccagaggaacatcggtagtatcactgatgagtatctttttggccgtctcaggaatacacacactgaaccaaatatttggacattgtatacaccaaaagatgcgacagtctaaaactaaacaatactttcttgccctctcagaatccaaaaaaaaatcatgtatcaaaagtataaaatggggccaactaaaggagttactcgaaataaatttctcttctgaatatatcagccaaataatcgcactcccaaatggccttagaacaaaatttgaaccaacttcgacatttatcacagtcaaaaactgtaatacaatttcagtttcaggtcagtacttcagaatgatggtagaatctccaacgcagccaaacttttgggagagaatgatctgtatcaatggatttaaagtaatgatacacattgatttattaaaacagcaaatgaaaaagttaaactctttacagaattgggaaaaattaccatccgccataaccttagaaaatgattcatggcacttttccataccgcatcatttcgagatgtttaaaataatagattctattccaactatatttaagagtattaaacaaatgttatattcgttgaaaacatcaaaagacgatttgataattttcccccacaaaatagagactcctttatcactgccaaagattaaactgaaatctaaaaggtggttatttagcatttctgatgatccactagaggcagaattgaatactatctttcagatcggtttacaagaacaacgggagagacttgcgaaattacaggaattcaataaacgcatctctgaagatttgattaaaagtcaaaagaacgctaaagaaatgaaggacgacttcgaggcaattgataacgcaatactaaagcaccgtacaggattgtgggcaaaggatgggaaaaaaagattgcgtaaatccgcaacagattctgaaatacctcttaccccagcagctttgaacattaatggaaagcgtgatgacaggcctgatagaacgcagtttatttctcccgagattgaaaatgcgtacaatactttattagcgaacttctccgattcatggattaaaagggtgaaagaatataaagttaaagaacgtcgtgagttcgataagaacttttctttcttatggggtttcattgattatactaagctccccaaagatattaacaaaaaagttttacctttctcaacaaatccttttttaatgaatttgataattgagaatatcgatattgatataataaggccttcatgtggcattgaaaatattccaaacttcattcacgatgttggaaaaggcgttccgaagaatacagaatattcgattatgattccgatgcatttagatgcgaaatttagtgaagtaagatggcatttgagagattatcccctgccttttgttagtatacctccactaagctctacacaaagtaaagaaacaatacctatgagaatttatggggattttatgataacagaggatatgcttcaatccgacagagagcttagaactttatttgttcctttaataccatcggtaactgttgaaaatacagatagatattactcgttgttcgtgcccagaacaatgactagcgctaagatattcaccgatctaaattttgaaataaactctaaccatacaacacgagtaacttggggtggttcttatcaaccagccattcaacaaacaatgcaatgtttggataacttttcaaagcctccattagatccttctgttaaactagggttttgggataaaacaagatatcttttccatggaaagatcaatatagtttggaaaaagaggggaaaattcgaaatttcccttaaaggcgcaaaaagtccctatatgcttggcggcgaatcagctggtttcatagttggttttgatggtaatgttaacttaaaatgtaacgaagataatgatcccaaaaaatttttatcctgcagcgcagacaaggtccatttcagcattcccaattattttgcaaagccgttactggtatggtctagacctagtaccaatacaatgttcattccaaaccaggacgatacgaacatgcagagatatgcttcattttactatttattgaacactacatcaagtaaaaacgaaaaagcagacaaggaaattatgggaaaatcgttcattgaaaagacaggaattaaactatctgggggtatgacactggatatgggtattctcttcgaaaggttggggcctagtttgaatgagagaacttttgagtccaaaaagcattatttgactcgtctatgtaacccaatttacgttcaagatctctcaaaacatgattcatatgctggctttagaagtgactttatacatatgtctttcgggctatcatctaactcaaactccgcatataacgctatgcaactaagtcccaacgggttcaaggcattctttgtttggtggaaatcattttcaggaaactttcccgtaaggagagggccattatttggtctccaaagtatcagtcctaaatttggtgaacatttatataccatttcttaccacgcagatgtctcaccattattcattaattacatgtaccacaacgctgatgccgatcaaattttgcgtaaaaactacttagaagttgccgaatttgctggtttaaaggctaaatcttctcattttattatggatcttcatcaaaggaaggaagtattgactgaatatcaagccggcttgaacgtcagaaggagagttatgaaattaaaatttctggctggtgatgttgtatgccaggacgtggacatccggactgtaagtggtgagttcagtaaattaaactacattgaagagaaagaggatgctgaatatgatatttttgataatgatatgtcgtggcttgatataacagattttcaagatgcatttttcattaaccctgataattatcttccaaaaattaagattatgccatttgccttttctcctcagttcgcttatcaaaaaagagctagttatggtgacaaataccaagttgatccgaaaacatgcaagccaataacgccgtttgataatcgtgtctcccatggctgtacactagggcacaatgtttctttacgtactgacctagttgagaaacgtgttacagttttgaagaagtttcgagagaaattgcaggagggtattagaaaaaacaaatcagccggtgtatcagaggagaatttgaatgatttactctcaaaagcaaattctagtgtggaaaatgcagaattactactgaaagacttccagaagatatttaaacaacatgaagccggacaaacagaacagcctttccatttcgactctttaaatctattgaaaaacaccaaaaagaccctgaaacaatttgaacatagattttttatttttaacgtactgttgaaatggaacgaggacgcaagaagtgctattttcaaatttttttactatgctaacctatccaatgaatttgcttctttagcaagtggcaagggcctaagggaatttgaagatgtaataaagcaaagagaaatgactgatgatacaacgagtatggaagcgataccagaaggaacagacaaagcaaacaccactaaacaatgtcatagctgcgatgatacagagttcaccactgagaaccttttgaatatatttgaaaaaaatattacacaactgtcttgtgacatcaaaaataagatacaccataagttttttgtccaatttataactccacaaattcagttgacatccctggaaaatccagaagcttgtgttttggtttcttcacccttttttatgctaaagacattggaatttgatgcaaacactaccagtaacacgtatatgcaagatatttttttgaaaagacatggcattctattcggaaacgccaatgcctttttatttaataaaaaggattaccaagagttttttgaactatacttcggctccagctcatatggccaagataaaaaagaacagtggccaccatggctaggcttggagttaggattcgaaccttctgcattaaaaaagaaagcagtggttaggaatatttctgctctgcttcatcatcagaaattagcaccgttttctgctaaatatgactccttaaaagataaaatagaagataatatttgcggatacgttcctcaagttaacgtacaagtgaattctgacgagtacctaatgctgacgaagatggccttgaaattattcctttatgtagaacccgaagatgaagaattgaagaaatatattgaaaaactaattattggttacgatatctatgatacagcccaaactagaaaattcgtaaatgatttacacgatagtgaacaaattctagctgttgttgaaaaggagcttttattcaaaagaagcctattggacgacattggaaaactcgatctatccaatattcacaacgaacgcatgcatcagttgttgaggttgtatatcttaaggaaggttttcacttcaaatggaaacaattacattaataggactttagtatggaatatcaaggttaatgaaactatcttgcatttattagacaaaattgacaaaccatttttagatattgccgttgcaaagctaaactttcaaagaatccaacacacgatgggattaaggaagaacactgtaaccgtaaaaatgatgcaaatatttgacttaggcgaaaatgttaattatcattgtattttagggcctttgataacatcaagtggtaatgacacagtcggtttggcgagtgatgttccgttagttcaaataacttgggatgttgataagcctgtaggtggtattaaggttgttaaaaacgttgagaccactttgtcgagtttgacgataaaattagaagaggacagactaaataaactttttgagtggttatcgttaaaggagttaatttacgatggaaacggagatgacgatgatggagcttccagtatttttgatatggtgtcatcagaatcagaggaaggaaaaattgagttttcagaagatattagttctgatttcaatgaaatgttaaagagatcaagtgattatatgatcgttgaagatcttaaattgaacagcttcaaactttgtatcagttataagggcaaaggaaagatgagattggctaacgttactaactttgttttcaatttcccgactttaagattgtccaaccaaactttgagggtcacagatctattacttgcccttaaaaaagtgttaatcaaggttttaataaaacatactgggagatttattggtaataaattgaaaagaaattctaaggagaataaaattgctgacgacacttcaccactgaagcaactcacaacttataattcctacacggagcctgaagaacttcgttaa

SEQ ID NO: 564 - DNA, 1596 bp, Saccharomyces cerevisiae
atggcttctacggaacttagcctaaaaagaaccttaacggatattttagaagacgagttgtaccatactaatccaggtcacagtcagtttacgagtcattatcaaaactatcatccaaatgctagtattactccatataagttggtgaataagaacaaggaaaacaacacttttacgtggaatcattcattacaacaccagaatgaatcgagtgcagcttcgatacccccacaacaaacctaccatttcccgatattcaacaaatacgcggatcctactttaactaccaccacctcttttacgactagtgaagcaacggccaacgatagacagattaataatgtccatctcataccaaacgagattaagggtgctagcgaaaccccattgcagaagaccgtcaatctaaagaatataatgaaagtatcagacccgtatgtaccgacacggaatacgttcaattatgatgttaaaatttccaacgattttttcgataacggtgacaatctatatggtaatgatgaagaagtgcttttctatgaggataattataatccgaaaatgcagtggtcacttcaagataatagcgccgcaataaacaatgaggatgcgagagctatttttaacaatgaatttgactctgatgacgacgatatcagtgatgatgaagaggatgaaatagaagaaaattgtttgcaacaagagcaacaccaagaggagcctttactgtcattggatgttacaccaatctcaatgtttggctcagatcaaaaaacgggtcgtgccaagagttctagtcatttatttaatgagtacagttacgttgactctaacatggacagcatttccagtgttgtatctgaagatctgttagatgaacggggacatgagaagatagaggatgaggatgaggataatgatcttgatgaagacgatatctacgatatctctctcttgaagaacagaagaaagcaaagttttgtcctcaataaaaacactattgattttgaaagatttccatctccctcaacctcggcaaacgtaccgtctactgctactaccggtaaaaggaaaccagcaaaatcatccagtaaccgtagttgcgttagtaacagtaatgaaaacggcacattagaaagaataaagaagcctacatcagctgtagtaagctcaaatgctagtaggcggaagctaattaattatactaagaagcacttatcttcacattcatctacaaattcgaattcgaaaccttcgactgcatcaccatcggcccatacgtcatcttctgacggtaataacgaaatatttacgtgtcagataatgaatctcattacaaatgaaccgtgtggtgcccaattttcaaggtcctatgatttaacgagacaccaaaataccattcacgctaaaaggaagattgtcttccgttgctcggagtgtataaaaattcttggatctgagggctatcagaagacgttttcgagactggatgctttaacaaggcatataaaatcgaagcatgaagatttgtcgttagaacaacgtcaagaagttacaaaatttgcaaaggctaatattggttatgtcatgggttaa

SEQ ID NO: 565 - DNA, 297 bp, Saccharomyces cerevisiae
atgataactaaatacttcagtaaggtaattgtcaggtttaatccctttggcaaggaagcgaaagttgctaggttagtacttgctgccattccaccaacgcaacgaaacatgggcacgcagattcaatcggaaattatctcagattacaataaagtcaagcctcttgtgaaagtaacctacaaggacaaaaaagaaatggaagtcgatccatcaaacatgaactttcaggaattagccaatcatttcgaccgtcactcgaaacagctggatctcaaacatatgttggaaatgcattga

SEQ ID NO: 566 - DNA, 363 bp, Saccharomyces cerevisiae
atgaccaccaattctcggctctgtccttcgagtccatcttcttccctaataaaacatttaactacatccgggggaccatcaacctcacttactataatgttgtcagtcatcgctatacgaatcctccctgctggcatgagaaattggatacgccaagccctgggcagcctcctctttgcatcgtttctcttgctttcatctttccactatccaattaccctgactctcgttcctgtctatcatgagtctcttgtcaagccaacaagtgcttcctttggaggtatacgattgtctcaacttactatgattatggagaggagagcaacgcctacgtgtcaagacccatcgttaaccgaggtctag

SEQ ID NO: 567 - DNA, 1908 bp, Saccharomyces cerevisiae
atggcacctgttacaattgaaaagttcgtaaatcaagaagaacgacaccttgtttccaaccgatcagcaacaattccgtttggtgaatacatatttaaaagattgttgtccatcgatacgaaatcagttttcggtgttcctggtgacttcaacttatctctattagaatatctctattcacctagtgttgaatcagctggcctaagatgggtcggcacgtgtaatgaactgaacgccgcttatgcggccgacggatattcccgttactctaataagattggctgtttaataaccacgtatggcgttggtgaattaagcgccttgaacggtatagccggttcgttcgctgaaaatgtcaaagttttgcacattgttggtgtggccaagtccatagattcgcgttcaagtaactttagtgatcggaacctacatcatttggtcccacagctacatgattcaaattttaaagggccaaatcataaagtatatcatgatatggtaaaagatagagtcgcttgctcggtagcctacttggaggatattgaaactgcatgtgaccaagtcgataatgttatccgcgatatttacaagtattctaaacctggttatatttttgttcctgcagattttgcggatatgtctgttacatgtgataatttggttaatgttccacgtatatctcaacaagattgtatagtatacccttctgaaaaccaattgtctgacataatcaacaagattactagttggatatattccagtaaaacacctgcgatccttggagacgtactgactgataggtatggtgtgagtaactttttgaacaagcttatctgcaaaactgggatttggaatttttccactgttatgggaaaatctgtaattgatgagtcaaacccaacttatatgggtcaatataatggtaaagaaggtttaaaacaagtctatgaacattttgaactgtgcgacttggtcttgcattttggagtcgacatcaatgaaattaataatgggcattatacttttacttataaaccaaatgctaaaatcattcaatttcatccgaattatattcgccttgtggacactaggcagggcaatgagcaaatgttcaaaggaatcaattttgcccctattttaaaagaactatacaagcgcattgacgtttctaaactttctttgcaatatgattcaaatgtaactcaatatacgaacgaaacaatgcggttagaagatcctaccaatggacaatcaagcattattacacaagttcacttacaaaagacgatgcctaaatttttgaaccctggtgatgttgtcgtttgtgaaacaggctcttttcaattctctgttcgtgatttcgcgtttccttcgcaattaaaatatatatcgcaaggatttttcctttccattggcatggcccttcctgccgccctaggtgttggaattgccatgcaagaccactcaaacgctcacatcaatggtggcaacgtaaaagaggactataagccaagattaattttgtttgaaggtgacggtgcagcacagatgacaatccaagaactgagcaccattctgaagtgcaatattccactagaagttatcatttggaacaataacggctacactattgaaagagccatcatgggccctaccaggtcgtataacgacgttatgtcttggaaatggaccaaactatttgaagcattcggagacttcgacggaaagtatactaatagcactctcattcaatgtccctctaaattagcactgaaattggaggagcttaagaattcaaacaaaagaagcgggatagaacttttagaagtcaaattaggcgaattggatttccccgaacagctaaagtgcatggttgaagcagcggcacttaaaagaaataaaaaatag

SEQ ID NO: 568 - DNA, 417 bp, Saccharomyces cerevisiae
atgatatttctaaaatctgtcatcaaggtaatcgacaattcaggtgcacaattagcagaatgtattaaagtaataaggaaagggtcccccaagagtcctgcaatggttggagacagaatagtctgtgttatacagaaagcaaagcccttgactcaaaacattacggggacagccaacaccaaccgtgtcaaaaaaggtgatatttgtcacgcaattgtcgtaaggtctaaacagcgtaacatgtgcagaaaggatggctccaccgttgcattcggagatactgcttgcgttttgattaataaaaataccggtgaacctctggggacaagaattatggctaatgatggttgtgtagatagaacactgaaagacaagggatacaataagatatgctctttggcaagtagggtcatataa

SEQ ID NO: 569 - DNA, 768 bp, Saccharomyces cerevisiae
atggtgaaattacaaaggtttagcgaaaagaaaagcctcatacacgaattcggcaagtttatccttgaaaagcaagaatcggcgttaacgggcgacgctgatgcagtgttcaatatcgccatcagtggaggatcgatgaaccaagcgctgtacgaaagtttggtaaatgacaaaaacatttttccacatattaagtggccacaatggagaatcttcttctgtgacgaaagattggttccatttgaggatccgcaaagtaactatggtcagttcaaaaaaacagttttggacccgctagtgcatcagggcaaccaattgaacttaggccccactgtatacactatcaacgaatcattaatcggtggcggtgaaacggccaatagaaagattgccgaagaatacgcttccatgctgcctgcatcattcgacctaatcttactcggatgcggagaagatggacatacatgctcgttgtttcccggggttgaatttaattaccttgtagaagagatggaccgcaaggttttatggtgtaataattcgcccaaggcacccaaggacaggatcacctttacattagcagtagtagccgaggctaaaagtgtgtgctttctcgttaggggagctgctaaaaaggctatcatgcatgacgtgttaatcgtaaaaaatagcgaactacctagtgtgctggttaatgaaatggtcggaaccaaagtaacttggtttctcgacgacgaagctggcgccttgattcctgaaaactgctaa

SEQ ID NO: 570 - DNA, 324 bp, Saccharomyces cerevisiae
atgagtagggctagcaagataacgtttgcagcttcctgtctgataacggcagcgacggtagtgggcgtgcattatgtgcaagaaatggaaagggaaactttgcatcagggtccgataaaagatgctaaacgagtcgaagaaaagaggttgagaaagacaaacggagttgcatcattagatcccacaaaagaaaggaaaaggtacttcaatatgagtgaacacgaggaacaaaaagagttgcgaaagaagtatgagaccatgcaaccgcttagtggagaagttgtgaccaaagatggagaggtggttaaagaatctaagaaataa

SEQ ID NO: 571 - DNA, 936 bp, Saccharomyces cerevisiae
atgttgtcaagaattgtatcaaacaatgcaacacgctccgtaatgtgccaccaagcgcaagtgggtattctttataagactaacccagtgagaacttatgctactttgaaagaagtggaaatgcgtttgaaatctatcaaaaatattgagaagatcacaaaaactatgaagattgttgcatctacaagattgagtaaagctgaaaaggctaaaatttccgcaaagaagatggatgaagcagagcagttgttttacaagaacgccgaaaccaaaaatttggatgttgaggctactgaaacaggtgctcctaaagagttgattgttgctatcacctctgataaggggttgtgtggttctatccactctcaattggctaaagctgtgagaagacatttgaatgatcaaccaaacgccgatatagtcactattggtgataaaattaaaatgcagctattgagaacccatcctaacaacattaaattgtctattaatggaattggtaaagatgccccaactttccaagaatctgctttgattgccgataagttattgagtgtcatgaaggccggcacttacccaaagatttccattttctacaatgacccagtgtcttccctatcttttgaaccatctgaaaaaccgatctttaacgccaagaccattgaacaatccccatcattcggcaaatttgagatcgacacggacgcaaacgttccaagagatttgtttgaatatactttggctaaccaaatgttgacagcaatggctcaaggttatgctgctgaaatttccgccagaagaaacgctatggataacgcttccaagaatgccggtgatatgatcaatcgttactctatcttgtacaacagaacaagacaagctgtcattactaatgaactggttgatattattactggtgcttcctctttgggatga

SEQ ID NO: 572 - DNA, 3294 bp, Saccharomyces cerevisiae
atgagtgaaaaaagatcccttcccatggttgatgtgaagatcgatgacgaggatactccccagttggaaaagaaaatcaaacggcaatcaatagatcatggtgttggaagtgaacctgtttcaacaatagagattattccgagtgattcttttcgaaaatataatagtcaaggcttcaaagcaaaggatacagatttaatgggtacgcaattagagtctacttttgaacaagacgtatcgcaaatggaacatgatatggccgaccaagaagagcatgacctgtcatcattcgagcgtaagaaacttccaaccgattttgacccaagtttgtatgatatttctttccaacaaattgatgcggaacagagcgtactgaatggtatcaaagatgaaaatacatctaccgtggtaaggttttttggtgtcactagtgaaggacactctgtactttgtaatgttacagggttcaagaactatctttacgtcccagcgcccaattcttccgacgctaacgatcaggagcaaatcaacaagtttgtgcactatttaaacgaaacatttgaccacgctattgattcgattgaagttgtatctaaacagtctatctggggttattccggagataccaaattaccattctggaaaatatacgtcacctatccgcatatggtcaacaaactgcgtactgcgtttgaaagaggtcatctttcattcaactcgtggttttctaacggcacgactacttatgataacattgcctacactttaaggttaatggtagattgtggaattgtcggtatgtcctggataacattaccaaaaggaaagtattcgatgattgagcctaataacagagtttcctcttgtcagttggaagtttcaattaattatcgtaacctaatagcacatcctgctgagggtgattggtctcatacagctccattgcgtatcatgtcctttgatatcgagtgtgctggtaggattggcgtctttccggaacctgaatacgatcccgtcatccaaattgccaacgttgtgagtattgctggcgctaagaaaccattcattcgtaatgtgtttactctgaatacatgctcacccataacaggttcaatgattttttcccacgccactgaagaggaaatgttgagcaattggcgtaactttatcatcaaagttgatcctgatgttatcattggttataatactacaaattttgatatcccttatcttttaaaccgtgcaaaggcgctaaaggtgaatgatttcccatattttggaaggttaaaaaccgttaagcaagaaattaaagagtctgtgttctcttcgaaggcttatggtacaagagaaaccaaaaatgtcaatattgacggccgattacagttggatcttttgcaatttattcagcgtgagtataaactaagatcctacacgttgaatgcagtctctgcgcactttttaggtgaacagaaggaggatgtacattatagcatcatttctgatctacaaaatggcgatagtgaaacaagaagaaggttggccgtttactgtttgaaagacgcctacctgcctttaaggcttatggaaaaactaatggcgttagttaactatacagaaatggctcgtgttacaggtgtgccattttcatatttactagctcgtggtcaacaaattaaagttgtttctcaactatttcgaaagtgcctggagattgatactgtgatacctaacatgcaatctcaggcctctgatgaccaatatgagggtgccactgttattgagcctattcgtggttattacgatgtaccgattgcaactttggatttcaattctttatatccaagtattatgatggcgcacaacctatgttatacaacactttgtaacaaagctactgtagagagattgaatcttaaaattgacgaagactacgtcataacacctaatggagattattttgttaccacaaaaagaaggcgtggtatattaccaattattctggatgaattaataagtgctagaaaacgcgctaaaaaagatctgagagatgagaaggatccattcaaaagagatgttttaaatggtagacaattggctttgaagatttcagctaactctgtctatggttttacaggagcgacggtgggtaaattgccatgtttagccatttcttcatctgttactgcttatggtcgtaccatgattttaaaaactaaaaccgcagtccaagaaaaatattgtataaagaatggttataagcacgatgccgttgtggtttacggtgacactgattccgttatggtaaagtttggtacaacagatttaaaggaagctatggatcttggtaccgaagctgccaaatatgtctccactctattcaaacatccgattaacttagaatttgaaaaagcatacttcccttaccttttgataaataaaaagcgttatgcaggtttattctggactaatcctgacaagtttgacaagttggaccaaaaaggccttgcttctgtccgtcgtgattcctgttccttggtttctattgttatgaataaagttttaaagaaaattttaattgaaagaaatgtagatggtgctttagcttttgtcagagaaactatcaatgatattctgcataatagagtagatatttcaaagttgattatatcaaagacgttagccccaaattacacaaatccacagccgcacgccgttttggctgaacgtatgaagaggagagagggcgttggtccaaatgttggtgatcgtgtggactatgtcattatcggtggtaatgataaactttacaatagagcagaagatccattatttgtactagaaaacaatattcaagtggattcgcgctattatttaactaatcaattacaaaatccaatcattagtattgttgcacctattattggcgacaaacaggcgaacggtatgttcgttgtgaaatccattaaaattaacacaggctctcaaaaaggaggcttgatgagctttattaaaaaagttgaggcttgtaaaagttgtaaaggtccgttgaggaaaggtgaaggccctctttgttcaaactgtctagcaaggtctggagaattatacataaaggcattatacgatgtcagagatttagaggaaaaatactcaagattatggacacaatgccaaaggtgcgctggtaacttacatagtgaagttttgtgttcaaataagaactgtgacattttttatatgcgggttaaggttaaaaaagagctgcaggagaaagtagaacaattaagcaaatggtaa

SEQ ID NO: 573 - DNA, 1086 bp, Saccharomyces cerevisiae
atgatttctgctaattcattacttatttccactttgtgcgcttttgcgatcgcaacacctttgtcaaaaagagattcctgtaccctaacaggatcttctttgtcttcactctcaaccgtgaaaaaatgtagcagcatcgttattaaagacttaactgtcccagctggacagactttagatttaactgggttaagcagtggtactactgttacgtttgaaggcacaaccacatttcagtacaaggaatggagcggccctttaatttcaatctcagggtctaaaatcagcgttgttggtgcttcgggacataccattgatggtcaaggagcaaaatggtgggatggcttaggtgatagcggtaaagtcaaaccgaagtttgtaaagttggcgttgacgggaacatctaaggtcaccggattgaatattaaaaatgctccacaccaagtcttcagcatcaataaatgttcagatttaaccatcagcgacataacaattgatatcagagacggtgattcggctggtggtcataatacggatgggtttgatgttggtagttctagtaacgtcttaattcaaggatgtactgtttataatcaggatgactgtattgctgtgaattccggttcaactattaaatttatgaacaactactgctacaatggccatggtatttctgtaggttctgttggtggccgttctgataatacagtcaatggtttctgggctgaaaataaccatgttatcaactctgacaacgggttgagaataaaaaccgtagaaggtgcgacaggcacagtcactaatgtcaactttatcagtaataaaattagcggcataaaaagttatggtattgttatcgaaggcgattatttgaatagtaagactactggaactgctacaggtggcgttcccatttcgaatttagtaatgaaggatatcaccgggagcgtgaactccacagcgaagagggttaaaattttggtgaaaaacgctactaactggcaatggtctggggtgtcaattaccggtggttcttcctattctggatgttctggaatcccatctggatctggtgcaagctgttaa

SEQ ID NO: 574 - DNA, 714 bp, Saccharomyces cerevisiae
atggctcgccaaaattttttaggcttggtcgtctcccaagggaagatgcaaaagacggttaaagtacgtgtagaaacaaaagtctttaataagaaaatcaacaaggagttatttcatagaagagattatttagtgcatgatgaaggtgaaatatcaagggagggtgatttagtaaggatagaagcgacgaggccgctttcaaagaggaagttttttgccattgcagaaattattagaaacaagggtcaacaatttgcattatacgaatcagaagctcagttaagcgttgcaaaagaagaagcccaaaaggcaaaagaatttttggataaaagatcagtgagggagaataaactaaatgaaaaaacaacccttttacgtgatattaggaccatccaagatgctttatctagcgggtcaacgccgaaagagttattggagattaaacaaaggtacggcattcaagatttttcacaagaaacagtgaggcaacttttacagttagacatctctggattggaggttaatttggagaaacaaagaagtctcattgatcgtattcaaacgcgattatccgaattgttgtcgaatgatctaaaatgtgatcaatttttgaaggatcatggtgttgaggatcctttgaccttgaaaaaaaacatcaaaaaaaatttgttaagaaagcacgtcatgatggatatgcaacaaccaagccagtaa

SEQ ID NO: 575 - DNA, 489 bp, Saccharomyces cerevisiae
atgaccacatctttttatgatttagaatgcaaggacaagaaaggcgaatcttttaagtttgaccaactgaaaggcaaagtagttctcatagttaatgttgcctccaagtgcggcttcacgccgcagtataaagaattggaagaactatacaaaaaatatcaagataaggggtttgttattttggggttcccatgtaatcagttcgggaagcaggaaccgggctctgatgaacaaattacggaattttgccagttgaattatggcgttacattcccaattatgaagaagattgatgttaacggaagtaatgctgactctgtctataattatttgaaaagccaaaaagcaggtttactaggtttcaagggtatcaaatggaattttgaaaagttcttagttgattccaatggtaaggttgtccaaagattttcctccttaacaaaaccatcgtccttggaccaagaaatccaaagcctgttaagtaaatga

SEQ ID NO: 576 - DNA, 1473 bp, Saccharomyces cerevisiae
atggaaagcaaagaaatatcaattaggtcaagaacccctccatcgaagctatattccatccaatcatgtattggcagaggtaactttggtgatgtgtataaagcagtggatagagttacgcaagaaattgtggcaattaaggtggtcaacctggagcattccgacgaagacattgaactgttagcacaggaaattttttttctggcggaattgaaatctcctcttattacaaactatattgcaacaatgttagaagatgtctctatgtggattgtcatggaatattgcggcggtggatcatgttcagatttactgaagcgaagttacgtcaacggtttgcctgaagaaaaagtttccttcattattcatgaagtcaccttgggtttgaaatacctgcatgagcaaaggaaaattcatcgtgatatcaaagcagctaatattttactaaatgaagaaggtatggttaagttgggtgatttcggagtaagtggccacattcgttccactttgaaaagggacacttttgtaggaacgccgtattggatggctccggaagttgtttgctgcgaagttgatgggtataatgagaaagcagatatatggtccttgggtatcaccacctatgagttactcaagggcttacccccattatctaaatatgatcctatgaaagttatgactaacttaccaaaaaggaagcctccaaaattacaaggtcccttttcggatgcagcaaaggatttcgtagctggttgtcttgttaaaacacctgctgatcggccatcggcatataacttgttatcatttgaatttgttaagaatatcaccataacgaacttgaaaagtgatgttgatctaattaaacagaaaaaggttcaggagagatatacaaaagttcccaaataccctcttcaaaatcgcttgtataaaaacagcaacacagtgaggggaaaggaattttggaattttgaatcgacaagactaagcacaacacaaatttccaaagaggaattatctcccattacacaagactctccaacatcatctttaaatatggaaagtccttatttacttcatgggcaaactgtaacgccgataaccaacccaagttcttcatcatttagaaaatgtacgcaaccagttttcgagcttgattcaggaatggatatagattcaggctgcccaaatgctcaagcagagaccgaaatagttcctctctctaatcataataagaagcataaaaagaacgatattcaggcgttgaagatagaaaagtttgactacttgaaaaacattgtatctcatattctcaacagaatgtatgatcgtgcgcgcgacgatgaaacaagaaaatacgtaaatgaaatgttaaagcaattcattaaaactgaggcaaacgttcctggatttaatgaggtttttatagaagagatctcactaagaattgaagcaataaagaaaggattcgtttaa

SEQ ID NO: 577 - DNA, 2988 bp, Saccharomyces cerevisiae
atggcaggcgtgcagaaaagaaaaagggatctcgaagatcaagacgacaatggaagcgaggaggacgacatcgcctttgatattgcaaatgaaattgccttaaatgatagtgagagtgatgctaacgactccgatagtgaagttgaagctgattatggtcccaacgatgtccaggatgtgatcgagtacagctcagatgaagaagaaggagtgaacaataagaagaaggctgaaaacaaggacatcaagaaaaaaaagaatagtaagaaggaaatagcagcatttccaatgttagaaatgtcagatgatgaaaacaatgcatctggtaaaactcaaaccggtgatgatgaggatgatgtcaatgaatatttctccacaaataacttggagaaaacaaagcataaaaaaggtagttttcccagctttggcctatccaaaattgtattgaacaatattaaaaggaagggatttcgccaacccactcctattcaaaggaagactatcccattaattttgcaaagtagggatattgttggtatggcacgtaccggttctggtaagactgcagcattcatcttgccaatggtggaaaaattgaaaagtcactcaggtaaaattggcgcccgtgcagtcatcttatcgccttccagagaattagccatgcagactttcaacgttttcaaggattttgccagaggaacagaactaagaagcgtcctcttgactggtggtgattccttggaagaacaatttggcatgatgatgaccaacccagacgttattattgcaacacctggtagatttttacatctgaaagttgaaatgaacctcgatttgaagagtgttgagtacgttgttttcgatgaagctgataggttgttcgaaatgggttttcaagaacagttgaatgaattacttgcatctttgcctacaacaagacagactttgttgttttctgctactctacctaattcattggttgattttgttaaggctggtttggttaatccagttttggttcgtttggacgcggaaacgaaagtttcagagaacttagaaatgctttttctatccagtaaaaacgcagatagagaggcgaacctattatatattttgcaagaaatcataaagattccgttagccactagtgaacaacttcaaaagctgcaaaatagtaacaatgaggcagatagtgactcagatgatgaaaatgatcgccaaaagaagaggaggaatttcaagaaggaaaagttccgtaaacaaaaaatgcctgcagctaatgaacttccttctgaaaaagcaactattctgttcgttccaacaagacatcatgtggaatacatttctcaactcttaagagactgcggatacttgatttcgtacatctacggtactttggaccaacatgctcgtaaacgtcaattatataattttagggcgggcttaacttccattttggttgttacagatgttgctgcaagaggtgtcgatattccaatgttagccaatgttattaattacacattacctggttcatcaaaaatttttgtacatcgtgtaggtagaactgcaagagccggtaacaaaggttgggcatattccattgtcgctgaaaatgaattaccttacctattagatttggagctatttttggggaaaaaaattcttctaacaccaatgtacgatagtctagtcgacgtgatgaagaaaaggtggatagatgaaggaaaaccggaatatcaatttcaacccccaaagctttcttacacaaaaagactcgttctaggttcatgtccaagactggatgttgaaggcttaggtgatctttataagaatctgatgtcctctaattttgaccttcagttggcgaagaaaacagccatgaaggcagaaaaactttactacagaacacgcacttccgcctcccctgaatctttaaagagaagtaaagagatcatttcttctggctgggatgctcaaaatgcattttttggtaaaaatgaagagaaggaaaaattggattttttggctaaattgcaaaacagaagaaacaaggaaacggtatttgagttcaccagaaacccagacgatgaaatggcagtgtttatgaaaaggagaagaaagcaattagcgccaattcaacgaaaggcgactgaaagaagggaactattagaaaaggaaagaatggctggtcttcacattctatcgaagatgaaattttggaaaggtgacgatgttgagacaggttacaccgtgtcagaggatgccttaaaagaatttgaagatgcgcaccaattattagaagcacaggaaaacgaaaacaaaaagaaaaagaaaccgaagtcttttaaggatccaactttctttttaagtcactatgcgccagctggtgacatacaagataaacaattacagataaccaatgggttcgctaatgatgctgctcaagcggcttacgatttaaatagcgatgataaagtgcaagttcataagcaaacagcgaccgtaaaatgggataaaaaaagaaaaaaatatgttaatactcaaggtattgataacaagaaatatattattggtgaaagtggccaaaaaatcgcggcaagcttcaggtctggtagatttgatgattggtcgaaggcaagaaatttgaaaccattgaaggtaggttcgagagaaacaagcataccatctaacttgctcgaagacccttcacaaggtcctgctgcaaatggtagaaccgtccgtgggaaattcaagcataaacaaatgaaagcgcctaaaatgccagataaacacagagacaattattattcgcaaaagaagaaggtggaaaaggctctacaaagtggaatttccgtcaagggatataataacgctccgggtctgcgaagcgaattgaagtccactgagcaaattagaaaggacaggattatagcagagaaaaaacgtgcgaagaatgctcgtccttccaaaaagcgtaaattttag

SEQ ID NO: 578 - DNA, 2400 bp, Saccharomyces cerevisiae
atgagttataaagtgaatagttcgtatccagattcaattcctcccacggaacaaccgtacatggcaagccagtataaacaagatttgcagagtaatattgcaatggcaacgaatagtgaacagcagcgacaacaacagcagcagcagcaacagcagcaacagcagtggataaatcaacctacggcggaaaattcggatttgaaggaaaaaatgaactgcaagaatacgctcaatgagtacatatttgactttcttacgaagtcgtctttgaaaaacactgcagcagcctttgctcaagatgcgcacctagatagagacaaaggccaaaacccagtcgacggacccaaatctaaagaaaacaatggtaaccagaatacgttctcgaaggtagtagatacacctcaaggctttttgtatgaatggtagcaaatattctgggacatctttaataccagttcttccagaggtggctcagagttcgctcagcaatattatcaactagttcttcaagaacaaaggcaggaacaaatatatagaagcttggctgttcatgcggcaaggctacaacacgatgcagaacgaagaggggaatatagtaacgaggacatagaccccatgcacttggctgctatgatgctaggaaatcctatggcacctgcggttcaaatgcgcaatgttaatatgaaccctataccaattcctatggttggtaaccctatcgttaataatttttccattccaccatacaataatgcaaaccccacgactggtgcaactgctgttgctcccacagcgccgccttccggcgattttacaaatgtagggccaacccagaatcggagtcaaaacgttactggctggccagtctataattatccaatgcaacccactacggaaaatccagtgggaaacccgtgtaacaataataccacaaataatacaactaataacaaatctccagtgaaccaacctaaaagtttaaaaactatgcattcaacagataaaccaaataatgtcccgacgtcaaaatctacaagaagtagatctgcaacctcaaaagcgaagggtaaagttaaagccggtctagtggctaagagacgaagaaaaaataataccgctacagtttccgcgggatcgacgaacgcttgttcgccaaatattaccacaccaggctcaacaacaagtgaacccgctatggtaggttcaagagtaaataagactccaagatcagatattgctactaacttccgcaatcaagcaataatatttggcgaggaagatatttattctaattccaaatctagcccatcgttggatggagcatcaccttccgctttagcttctaaacagcccacaaaggtaaggaaaaatacaaaaaaggcatccacctcagcttttccagtagagtctacgaataaactcggtggcaacagcgtggtgacaggtaaaaagcgcagtccccctaacactagagtgtcgaggaggaaatccactccttctgttattctgaatgctgatgccactaaggatgagaataatatgttaagaacattctcgaatactattgctccgaatattcattccgctccgcccactaaaactgcgaattctctcccttttccaggtataaatttgggaagtttcaacaagccggctgtatccagtccattatcttcagtgacagagagttgcttcgatccagaaagtggcaagattgccggaaagaatggacccaagcgagcagtaaactcaaaagtttcggcatcatccccattaagcatagcaacacctcggtctggtgacgctcagaagcaaagaagttctaaggtaccaggaaacgtggttataaagccgccacatgggttttcaaccaccaatttgaatattactttaaagaactctaaaataatcacttcacagaataatacagtatcccaagaattgccgaatgggggaaacatactggaggcgcaagtaggcaatgattcaagaagtagtaaaggcaatcgtaacacattatctactccagaggaaaaaaagccgagtagtaataatcaaggatatgattttgacgccctcaaaaattcaagttctttgttgtttcctaatcaagcttatgcttctaacaatagaacaccaaacgagaattcaaatgttgctgatgaaacctctgcatctacaaatagtggcgataatgataacacattaattcagccctcatccaatgtgggtacaactttgggtcctcagcaaaccagtactaatgaaaatcagaatgtacactctcagaacttgaagtttgggaatattggtatggttgaagaccaaggaccggattacgatctcaatttactggatacaaatgaaaatgatttcaattttattaattgggaaggctga

SEQ ID NO: 579 - DNA, 564 bp, Saccharomyces cerevisiae
atgagtgcgaaacaagggtgggaaaagaaatcaacaaacattgacattgcaagcaggaagggtatgaacgtgaacaatctttcggaacatctacagaacctgatatcaagcgattcagagctgggctcgcgcttgctatcattgctgctggttagcagtggcaacgcggaggagctcattagcatgataaataatggccaggatgtctcgcagtttaagaagctccgcgagccgagaaaggggaaggttgccgcaacaacagcagttgttgtaaaagaagaggaagctcccgtgagcacttctaacgaactggataagattaagcaagagcggagaagaaagaacacagaggcgtcgcagcggttccgcattcgcaagaaacaaaagaattttgagaacatgaataagctgcagaacttaaacacgcaaatcaacaaacttcgcgatcgtatagagcaattgaacaaggaaaatgagttttggaaagcaaagctcaatgacattaacgagattaagtctttgaaattgttgaatgacattaagagacggaacatgggcaggtag

SEQ ID NO: 580 - DNA, 303 bp, Saccharomyces cerevisiae
atgccaccaattatgctaaaccgtttcactttaagaaatttttatttaaatctttcactatgcaaatatgtaagtacttttaaaattctctttccaaagaaaaggaaattatttcagactagcagtaatttatcactttgctattcagatattaggagaacatccttatcgagcaaatctgcctcgcttgagctgacaacgtcatcttcgtcagtactctcgccatccagtaaatatgtgttttcattcaattcattgaaaaacggggttttcagtaaatcttctgctgaactacgcttttga

SEQ ID NO: 581 - DNA, 1908 bp, Saccharomyces cerevisiae
atggctaacgacgctctaagtgctattttcagtaatccttcgaggaaaggtgtccaaccctccacatctattgtgtcatatacaaacaatgaagatgatattatagatgtggaaaatgggaagttcaacaagaacaagaatatcaacactaatgtgtatgtggacaactcctcaatagaggagagcgaagtcgtgcccttgcccgaaacaaagtccatctggagtaaaatatactacgatttcattgtgttagacaagacaactttgaatgtttcgttgaaagagtcgttcttgtataacagagacttgaaaccggttgaagaagaaagaaggtgttggtcctggttcaattacttatatttctggctggcagactgtttcaatattaacacatggcaaatagctggtacaggtctacaactaggtctgaattggtggcaatgttggcttacagtttggatcggctacacttttgcaggtatcttcgtagtattgaactcgagatttggttccgcatatcacttatctttccctattactgttagggcctcatttggtatattcttttctatgtggccgattataaatcgtgtcgtgatggctatagtatggtatgccgtgcaagcctggttaggtgcaacgcccgtggcactgatgctaaaatctatttttggcaagaatctggaagatagaatcccaaaccattttggttctccaaatagcactacttttgaattcatgtgtttctttatattttgggtggtcagtataccatttgtcctagtggctcctcataaaatcaggcatttattcacagtaaaagcagctttgatccccttcgcagcctttggatttttaatctgggctttgaagaaatcgcacggtaaaattgagttggggacgctgaatgattattcacctcatggttccgaattttcatggatattcgttagatccctaatggcctgtgttgctaactttgccgctttgattatcaacgcccctgacttcggtagatttgccaaaaatcctcaagcgtctttgtggccacaattggttgccatcccattgttcttcgccataacatgtttgatcggtatcattgttactgcggccggttatcacttatatggggttaactattggtcaccactggatgtacttggtcaatttttggagaccacttacaccagaggtactagggctggtgtgttcttgatttcttttgtatttgccttagctcaactgggtacaaacatttctgccaactctctggcatgtggtgctgatatgacggctttgtttccaagatatattaatattagaagaggttctttattctgtgtggcaatggctctatgtatctgtccatggaacttaatggccagttcaagtaagttcaccagcgctttgggtgcttatgcaattttcctttccagtattgctggtgtcatttgcgcggattatttcgtagtaagaagaggatatgtgaaattaacacatttattcctggcacagaagggttccttttacatgtttggaaacaaatttggtgccaattggagggcctttgttgcgtatatttgcggtatcgctccaaatttaccaggttttataggtgatgttggagctccaaaaattacggtttcagagggtgcaatgaggttatactatttaggttatccggtaggtttctttattagtgcggtgatatacctcatattatgttacttttttcctgtccctggtactcccgtaaccaattttctgacagagaaaggatggttccaaagatgggcttatgttgaggacttcgagcaagattggaagaatgagttacgtagggatgacctctgcgatgacacagtcagtatctatgatggcaccgaggaaaagatagtttactaa

SEQ ID NO: 582 - DNA, 3819 bp, Saccharomyces cerevisiae
atgccgaacgaagataatgaacttcaaaaagcaattgagaaccatcataatcaactactaaaccaggataaagaaaatgctgacagaaatgggtctgttatagaagacctcccattatacgggacaagtataaaccagcagtctacccctggagatgttgacgatggaaaacacttactgtatccagatattgccaccaacctaccactgaagacttctgacagacttttggacgatatactttgcgatactatttttctcaattctacagacccgaaggtcatgcaaaagggcctgcaatcgaggggtattttaaaagagtctatgctttcttactcaactttcagaagtagtattcgccctaactgcttgggttcattaactgatcaagtggtttttcaaacaaaatccgagtatgattccatttcatgcccaaaatataataaaatacatgtatttcaggcggtcatctttaatccatcactggcagaacagcaaatttcaacttttgatgatattgttaaaattcctatttatcatcttaaggttagcgtaaaagtccgccaagaactggagcggttgaagaagcatgtcggtgttactcaattccactcactagatcatttgcacgaatacgatcgagtagacctttcgacttttgattcttccgatcctaatttgttggattacggtatttacgtttctgatgatactaacaaactgatcttgattgaaatttttaaacccgagtttaattcacctgaagagcatgagagttttactgccgacgcaattaagaagagatacaatgctatgtgtgtaaaaaatgaatcactagataaaagcgagacgccatctcaagttgactgtttttacacactttttaaaatttttaaagggcctttgacgaggaaaagtaaagcggaacctacaaagacaattgattctggaaatttggcccttaacactcacctgaatcctgaatggttaacgtccaagtatggatttcaagcaagctcagaaatcgatgaggaaactaatgagatatttactgaatacgtccctccagatatggtggactatgtaaacgatttggagacaagaaaaattcgagaatcgtttgtgaggaagtgtttacaactgatattttggggtcaactatctacctcattactggcacctaattctcccttgaaaaatacgaaaagcgtaaagggaatgtcttcattacaaacttctttctcaacactaccttggttccatttattgggagaatccagagcaaggattctattaaattccaatgagcaaactcattcgcctttggacgcagaacctcattttattaatctttccgtttcgcattattataccgatagagatataatcagaaactacgaatctttgtcttctttggatcctgaaaatattgggctgtattttgacgcactgacatacattgcaaataggaagggggcatatcaattgattgcttactgtggaaaacaggacattataggccaagaagctctagaaaatgctttgttaatgtttaaaattaaccctaaagagtgtaacatctccgaattaaatgaggcgactttgctatctatttacaaatatgaaacatcaaataagagccaagtaacctctaatcacctaacaaatttgaaaaatgctctaagattgttggccaaatataccaaatctgacaaactaaaattttacgtcgatcatgagccctacagagctttatcccaggcatacgacacactttcaattgacgagtctgttgatgaagacattataaaaactgcatattcggtcaagattaacgactctcccggattaaagttggattgtgatagagcactttacaccattgctatcagtaaaagaagccttgatttgttcaattttttaacagaggaatgcccacagttttccaactattatggtccagagaagcttgattaccaagaggcattgaagcttcttcaagtgaatgaaaatgcctctgacgaaaccattttgaaaatctttaaacaaaagtggtttgatgaaaacgtttatgagcctgaccaatttcttattttgagggcagcattgaccaaaatcagtatagaaagaaattcaactttaatcaccaacttcttactaactggtacgatagatccaaattccttgccgccagaaaattggccaactggcattaataatatcgggaacacctgttacctaaattctttattacaatattacttttccattgcgccactaagaagatatgtattggaatatcaaaaaacggtagaaaatttcaatgaccacctctctaatagtgggcatattagaagaattggtggaagagaaattagtagaggcgaagtggaaagatctattcaattcatataccaacttcgcaaccttttctatgcgatggttcatacaagagaaagatgtgtaacaccctcaaaagagctagcatatttggcatttgctccaagtaatgttgaagtagaatttgaagtggaaggcaataaagtagttgatcaaacaggagttctttcggattcaaagaaggaaacaacggatgacgcatttactacaaaaataaaggatacaagcctgattgatttagaaatggaagatggccttaatggcgatgttggtacagatgcgaacagaaaaaaaaatgaatcgaatgatgctgaagtaagtgagaacgaagatacaacaggattaacttcacctacgcgtgtggcaaaaatcagttctgatcaattagaaaatgctttggaaatgggtaggcaacaagatgttactgaatgcataggaaacgtgttatttcagatagaaagcggttcagagcctatccgatatgatgaagacaacgagcaatatgacttggttaagcaactattttatggtactactaaacaaagtattgttcctttgtccgcaacaaataaagtccgtacgaaagttgaaagattcctatcgttactgataaatattggcgatcatcctaaagatatttatgatgcgtttgattcttattttaaagacgaatatctgacaatggaagagtatggtgatgttatacgtaccgttgctgttacaacttttcctactattttgcaggtacaaatccaaagagtttattacgatcgtgaaagattaatgccgtttaaatccattgagcccttaccattcaaagaagttatttacatggacagatacgcggatacagagaaccctttattgttggcaaaaaagaaagaaacagaagaaatgaagcaaaagttgaaggtaatgaaaaatagacaaagagagcttttgagtcgtgatgattcagggcttacaaggaaggatgcatttttggagagtatcaagctattggaatcggataccataaagaaaactcctttaaaaattgaggctgctaatgatgtgataaagacgctgagaaacaacgttcaaaatatcgataatgaattgatgaaattatacaatgatatcaacagtttggaagagaaaataagccatcaatttgacgatttcaaggaatatggttactcactgttttcggtttttattcatcgcggcgaggccagttatggtcactattggatatatatcaaggacagaaatcgcaatggaatttggaggaagtacaatgatgaaaccatcagtgaggtccaggaagaggaggtcttcaatttcaatgagggtaacactgcaactccatatttcctagtatatgtcaaacaaggacaagaaggtgatattgagccattgaaaagaattctaaagtag

SEQ ID NO: 583 - DNA, 306 bp, Saccharomyces cerevisiae
atggagatgctcttgtttctgaacgaatcatacatctttcataggtttcgtatgtggagtattgttttatggcactcatgtgtattcgtatgcgcagaatgtgggaatgcctattataggggtgccggggggtgccttgaaaaacccttttgcgcgcctgttaagtttccgttttcagtcaaaaagaatatccgaattttagatttggaccctcgttcagaagcttactgtctaagccatcatttggtgtgtcctaaacggtttccatgcaaagcaacatctttgttactcattcctgaaggttga

SEQ ID NO: 584 - DNA, 1152 bp, Saccharomyces cerevisiae
atgcaaaaccctccgttgattcgtcccgatatgtataatcagggaagcagctcaatggctacttataatgcctctgagaagaatctaaatgagcatccttctccgcaaattgcacagcccagcacgtcccaaaagttaccttatagaataaatcctacaaccactaatggggacaccgacatatctgttaacagcaatcctatccagcctcctttgccaaacttgatgcatctatctggtccgtctgactatagatcgatgcatcaaagtcctatacatccatcttatatcatccctccgcattcaaatgaaagaaaacaatcagcttcttacaacagacctcaaaatgctcatgttagtattcaaccttccgtggtattcccccctaaaagttattccatatcttatgcaccttatcaaataaatccccctttaccaaatggacttccgaaccagagcatatctttgaataaggagtatattgcagaggagcaactatcaaccctcccatctcgcaataccagtgttactactgcacctccttcttttcaaaacagtgctgataccgctaaaaattcagctgataataatgataataatgataatgtaaccaaacctgttcctgataaagacacccaactcataagtagttcaggcaaaactttaagaaatactagaagagctgctcaaaatagaaccgctcaaaaggcatttagacaaaggaaagaaaaatacatcaagaatctcgaacaaaaatcaaagatatttgacgatttactagcagaaaataataacttcaaatcattaaacgattcattaagaaatgacaacaacattttaatagctcagcatgaagctataaggaatgcaattactatgttaagaagtgagtatgatgtcttatgtaacgaaaacaacatgttgaagaatgagaatagtataataaaaaatgaacacaacatgtcaagaaatgaaaatgaaaacctaaaacttgagaataaacgcttccacgctgaatatatacgaatgatcgaggatattgaaaatactaaaagaaaggaacaagaacaacgagatgaaatagagcaactaaaaaaaaaaataagatccctggaggaaatagtagggagacactcggatagtgccacgtaa

SEQ ID NO: 585 - DNA, 576 bp, Saccharomyces cerevisiae
atggaggatcaggatgctgcatttatcaaacaggctacagaagcaatagtggatgtatcattaaatatagataacatagatcctataataaaagagttattagaaagggtaaggaataggcaaaacaggttacaaaataaaaaaccagcactcataccggcagaaaatggtgttgatataaatagtcaaggcggtaacataaaggttaaaaaggaaaacgcattaccaaaaccaccgaagtccagcaaaagcaaaccccaagatcgtagaaatagtactggtgaaaaaagatttaaatgtgcgaaatgttcgttggaattttcaagatcatcagatttgagaaggcacgaaaagacacacttcgccatattgcctaacatttgtcctcaatgtggcaaaggttttgcaaggaaagatgcattgaaaagacattatgatacactgacatgtaggagaaacaggactaaattactaactgcgggtggtgagggtatcaatgaattactgaaaaaagtcaagcaatccaacatcgttcatcgtcaagataacaaccacaatggtagcagtaatggctga

SEQ ID NO: 586 - DNA, 933 bp, Saccharomyces cerevisiae
atggtaagtgattggaaaaatttttgcctcgagaaagcctctaggtttcgcccaacaatagataggcctttttttaatatttatttgtgggactatttcaatcgtgcggttgggtgggccactgcaggtcgcttccagccaaaggattttgagtttaccgttgggaagcagcctttgagtgaacctcgtccggtactgctttttattgccatgtattatgtggttatatttggcgggaggtccctggtaaagtcatgtaaacctctcaagttgagatttatttctcaagtccataacttgatgttgacttctgtttcctttttatggttgattttgatggtggaacagatgctacccatagtgtatcgccatgggctgtattttgctgtttgtaatgttgaatcgtggacgcaaccgatggagacattatattatctcaactatatgacaaagtttgtggagttcgcagacactgtcttgatggtgttgaaacatagaaagttgactttcctacatacataccatcatggtgctacagctttactgtgctataatcaattggttggttacacagcagttacatgggttcctgtcaccttaaacttagctgttcacgttcttatgtattggtattatttcctttctgctagcggaattcgtgtttggtggaaagcctgggttacaagactacaaattgtgcagttcatgcttgatctcattgtcgtttattacgtgctttatcagaagattgttgctgcatatttcaaaaatgcttgtactccacagtgtgaggattgcttaggttcaatgacggctattgctgctggtgcagccattcttacatcctacttgtttttgttcatctctttctatattgaggtttacaaacgtggaagtgctagtggtaagaagaagatcaacaaaaacaattaa

SEQ ID NO: 587 - DNA, 5097 bp, Saccharomyces cerevisiae
atgtccttaccactaaagccccttacaattgactcaaataataaacaactagactccaaacagaagaagtttcgtgctaatgtcgagcgagcattagaaagatttgactctgtaacagaatgggcggactatattgctagtttgggaacactattaaaggcgttgcaaagctggtcacctaaatttcagaatgtaaggtactatgttccttctccatatcaagtaagtcgaagattgacatcctcattatcgccggcgttaccagcaggtgttcatcagaaaactttagaagtatatacgtatatctttgaacatattggccttgaaactctggctacagaatgtaacatttggatcccgggaattttacctttgatgacttatgcctctatgtctgttaggtcacatttgatagagctttacgataactatatccttctgttgcctcaaacaacgttaagactgctcatcagacctttgatttctagtttattgccaggaattgatgatgaaagcaacgattttttacctttaactttaaaactcattgagactctgcaggagaacttggatgatgattccttattttggcaaacgttgtttctagtcatgactgcaaataaaggcagaagactgggcggactcacgtggttgactagaaagtttccgtcgttgaatgctgtacctcatctagtaaataaaataaaaatggaagcggaagagaacccaagtgaaactgaaaccaacgattctcatctagacaggaaaaaaagaaaagaagaagctttcaaggtcttattgcctgctgccaaagatttagtaacccctgaaccaggtctacttatccgatgccttgtcggttgtttagaagatgaaaatgatattcttattaaaaggagcgttttggaccttttattacagaggttgaggctagactctcccgttttgaatgttcttattacttctgaggataaaaagttattgataatgagttgttgtagaactactttgagcaaggatatgtctttgaacagaagaatatggaactggcttctcggtcctactgctgggggcatgctaaacaataacggcgggaactccatggaatatactacctcggttaagtcagcaaacgaggaaagtaatgtatattttacaaaatatggattaagcgcccttttagaaggtttaagcgaccttctttcagaagaagaatccgtgttaactgcattcaggataagtatggcagtaatggatagatgggaaattggctcacttgtaattcctgaattgttcatcccacttctctattcctcggaaaaatttaaacaaaacgaacaaataatgaaaacggcacgtactttctttgacaatactgaaacaaatattatatggggaaagctatttcaagaacttgaagacatcaaaaacctaaaaattttggatttcgtattaacaaattttaatattggaaacgacgaagagattatcgtacgccaccttcctttgatattattaactttactggcccttccatctaatgataaagatttcgacaatatttataagctccaaaaattttctttgtacaacaaattgttaaactatatccccgagagagcccttctccctctcagtcactcaaaactaaagcacgatgatgaagtaagctgcgaagaacttttggccaaaatacgtgggttttataccaatgtttctaatccatctagcattttagagaaagaaaatatagctgagcgtttgccaccctttacaacagaagatctaacttttttaatagcagacctgattcagaagaagcttctttcaagtttatgggacttggaaaatatcaatgaaagctccaaattatttatagctattttcgaaaagatacctgagtctgaagaacttaaaggacgatctcacataagctggtcggataaaaaaataactcagagcatatttgaggctattcccaggctttgtgaatctaataatgatgcaaaatcagaagaaatcgttggaattgtggaaatttttggtaactacttatattcacgcatggaattcattgaatcgatgaaattattgaaagtagtcatgatggccgtatggaaatctttaaaagatccacgccatcaaatactaggtgtcaagaacttaaagactttaaacagatttattccatccaaatttattgaaagtgcgttagtgtatacttttgtggaagaggaagatatatccgagagattaagcgtgttagatctgttatggacacaattagactcagattcaaacttgattaggcgccctcttgaattaattttgggcgaactttttgatgaccagaatcctttttatttaaccgtttcaaagtggattttatcgatattaaactcgggatctgcttcaagattattttacattttgactgataatattttaaaggttaatcgtctcgaaaaagaaagattagacgaaagggatgatcttgatatgctcacatatgagttccaaatgcttgcttatgttttgaaaacaaacaatggacgcactaggaaagttttttccactgagcttacctcaataaaatcttcgaccatatggaagaatgaagacgtttccacatataaaagtttgctgttggttacattgatgagatttctaaatataaagagcaatacacatgcgaaaagtatcaggagtgctctgattcttttggatatcttactcgatggaactgagcaaaatttcaaggacattgtcatatttttgctgcaaatgtcgtctaaatatattgcagaagaaggaattgagcccgagttaatagcagtttccttgttagatattgtatcgaaggttctcagactatcacacgataatggtattaaactagacatttttgatgacaatgctgcccatttaaaatatatcgatttccttgttaccagcgtttcaaatatgaaaagccctcttattgtaacggcctatgtgaagcttctttccgaaagcattgtttattttgagaattctatatttcgaatgattttaccattgtctgcatctcttgtacagtgtgttcagagattgtttttgctagaaaagagagaaggtggttattaccaaccaatagctttgcttctgggtggtctggaagagctattagagatttcacatggttaccttgtcaccgaggaaagggaaggatacttttctgggtctaatctaaagggtgattttattcaatccgttgtttcaaacgttttttcgtcagattcttccaatgaagaaagtaagattcagggggaaagagacgtaatactacaatctttcagacaggtgatttcatgctgtttagatatctggtattgggcccataacatttcgtgtaaatctaacgatgattctagcctggacgccactaatcataactcatacaagttcaaatttaggtcgaagaaactgttggaaaccttatttctactagaacctttggaacttctggaaaatttgatcagcattagatcagacaatactacagtcacactagtacatgtgctcgacggcaataaacccgccattacaataccacatttattgtatggtgtaattatcagatacaacagaacggcatctgtcaagttttctaatcgtgacggaagtaggtcaagcacaactaaattaactaaaggggagccttccatgttaaaaagattaagcggggaatcgattattgcatttttgtttaactacgtggattctgtagaaaactctgcaatggaggagttttatggggatttcctgctatttttcagagaagtagcaaccaattataacctttattctgatgtttcgttgtctatattaaaacttgttgcccttatttctggaaaagtaagtaaaacgcagtttggagaacaaaaacgagttaggagggagatatctgatgtgtttttcaaatacctacctaatgcatttataaactttacgaacttatatcgtggccaccctgattcatttaaagatttagaatttgtagtatggcgtgttcaatatatcgtcaacgatcaaattggaggagacaagtttaatacaacgttagcgacaattgtaaatcaatgcctaaccccttatatcaaacccaaaagtgaaaaaactattccaggttatgtcttagaattggccgcggtcgtatcccatttaggttcaaaagttaaaagttggaggcttttaattgcggaattgttccaaaatgacaaaaaactttcggtaattggcagcgatcaaacttgggaaaagattatttacgaatggtccatttatccagaaaataagtcaaaaatcttgaacgatttactattagaaattggctccaagcgttcaagtgtgactccgactttaatcacgtttaacttaggaagcgattctgaagtcgagtacaagtgccaaaaccttttgaaaatatcgtacttgttgatggtatcgccaaatgacgcatatttgttgcacttttcctctttaataagttgcattttccactatttggtgtccaaagatatcaagctcaagggaagctgctggatcttactaagggttttacttttaagattttcagagtcccatttcaatgactattggtctatgatcagttactgtttacaaactaatttgcaagaattttatgaatcacttcaaatacagtcagaagtcgatccacaaacaatattgcaagtatgtaaaactttggatttgctactcttactcaacatggaaggcttcacctctacgaatgagtggatctttgttattgatacaataaattgcgtatataaaacgaactcattcgtcgcgctggtagatgaaatcgcagaattcaaagattacgaaataaccaaaactgatgatcttgaattaccgacaactttaaaagatggtctcccattattacgaggcattcacaaaatcgagagacacacgcaactaagaagcttcttccagaatttgagttatctacattatgagaaagtttacggactagggtcagttgatttatatggttgtggtgaagatctcaaaaaagatattctgtcatga

SEQ ID NO: 588 - DNA, 1860 bp, Saccharomyces cerevisiae
atggacgatagtgtcagtttcattgccaaagaggccagtccagcacaatattcgcacagtttgcatgaaagaacacacagtgaaaaacaaaagagagactttacaataacagaaaaacaagatgaggtatctggacaaacagcggagcctcgaaggacggacagcaaatccatattacagaggaaatgcaaagaattcttcgactcttttaaaaggcagctgccaccagaccgtaattccgaactagagtcccaagaaaaaaacaacctgacaaagtcgatcaaatctcgtcacttagtcatgatcagtctcggtaccggtataggtactggtttactggtcggtaatggtcaggtgctgggaacagctggtcctgccgggttagtccttggttacggaatagcatcgatcatgctttactgtatcatccaagcggcaggcgagttaggtctctgttatgcaggactaaccggcaattacaccagatatccttctattttagtcgacccttcgttgggttttgcagtttctgtggtttacaccattcaatggctaactgttctgcccttacaattggtcactgcggcaatgacagttaagtactggacgagtgtaaatgcagacatctttgttgccgtggttttcgtttttgtaattatcattaatctatttgggtccagaggctatgctgaagccgagttcattttcaattcctgtaagatattgatggtaatcggattcgtcattctggcgattatcatcaattgtggtggtgcaggtgacagaagatacatcggtgctgagtactggcacaatcctggtccatttgcccacggtttcaaaggtgtatgtacggttttctgttatgctgcattcagctacggtggaattgaagttctacttctatctgccgctgagcaggaaaacccaacaaaatctattcccaatgcctgcaaaaaagtggtataccgtattctgctgatttacatgctcaccaccattttggtttgctttcttgttccatacaacagtgacgaattattagggtctagtgactcctctggatcccatgcctccccatttgtcattgctgttgcatcacatggtgtcaaagttgtgcctcactttataaatgctgttattttgatttctgtcatttctgttgcaaactcttcgttatattctgggccaagattgttattatcattggcagaacaaggcgtcttacctaaatgcttagcatatgttgatagaaacggcaggcctttactttgtttttttgtttcccttgtctttggatgcattgggtttgtagccactagtgacgctgaagaacaggttttcacctggttattggcaatttctagtctttcgcaattatttatctggatgtcaatgtccttgtcacatataagatttagagatgccatggcaaagcaaggtcgttcgatgaacgaagttggatacaaagcacaaactggctattggggttcatggcttgcagttttaattgcaatcttcttccttgtgtgccagttctgggtagccatcgcacctgttaatgaacatggaaaacttaacgtcaaagtgtttttccaaaattatttggcaatgcccatcgttttgtttgcctattttggtcacaagatatacttcaaatcatggagcttttggattccagccgaaaaaattgatttggactcacatagaaacatatttgtgtctccatcgcttacagagatcgacaaagttgacgataacgatgatcttaaagagtatgaaaattcagaatcgtcggaaaatccaaacagctcgcgttcaagaaagttttttaagaggatgaccaatttctggtgctaa

SEQ ID NO: 589 - DNA, 330 bp, Saccharomyces cerevisiae
atgacaatgatacgtttttgtggcgcgcgtcaatcggcgataatcagcaacgcgtctgacgctgctgcaggaaccaacaaaaaaaggatactaaaccctcttgagtccttgtgtcttaacgaccgcatagacgaacaccgttgcaaagaagtccagttatcttcattacgaagtctattgtatgctatgattttaaatagaaccataggcagcgagaccggcgttttttcttttctgctcttttcttttcgttacttcggagaggaaagagacttattttactgcttcttctccgtctttttacttaacattacatatttattggattag

SEQ ID NO: 590 - DNA, 330 bp, Saccharomyces cerevisiae
atgagctgttcacccaatttttgtaaagtttcgtttcttgtttcaaatgtatttcctgtgctcaagtctccagtcattggtactcgtaccaacatattcctgcttgtggtatatagcagtttagttagttctttagtcggtatgcgttcctttcctttatatccgtcaggattaacttcaaggacttcacacagtttttctatcttactaatattctttttcgtcaccgtgtttatagttctgatgggaatatacctgcgaatcccagatattcgagcaacagtagttgcaaacacttttgtcctcaacatgtcgagattcattatctga

SEQ ID NO: 591 - DNA, 369 bp, Saccharomyces cerevisiae
atggcgtctacggtagccggattatcaatgtcagcggaatcgctccggttaccgctattaataggagtaagtagcggtatgttatcagtgtctgatgcagaggtattaccatcgttcctcttcaaatctggtttctcagtattacaaagtgctgcattggatacagatgacgacctcgcacgaggcttatcattgctagacctgttaccactcgtgctattgtctccgtttttcgaagaggacgtagatgaagaggaggctggcgacgtagaaggcctcgatggcttcgtatttgtcttccgtctactcttacctttatacaaccaatctacgggcacatcgaactcggtgttagttatcataacctag

SEQ ID NO: 592 - DNA, 366 bp, Saccharomyces cerevisiae
atgaatgtagttgccattataatggcttctcaggaaacctgtagcggccgggccccgcgagaaactccagagtggcgtaggccggcttgtttagttgctagcatacttgttcgagctcttgagttctcctggcttttctccacgtgtctgcttgttgcctttgatttcgcgagagactgcggactgccaccccactccgggaaaacctggagtgatggtaaaggccctgcggcgctttctttcggaaaaactaatacgaaagaagcaacaacaaatttttacaacaggctggacgagaaaagtggggaagagcaagcagaaaaaagaaaagagaatagtcgttcttggataatttatttattataa

SEQ ID NO: 593 - DNA, 357 bp, Saccharomyces cerevisiae
atgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagagcaccgttgctag

SEQ ID NO: 594 - DNA, 387 bp, Saccharomyces cerevisiae
atgttccatttgaaggcgttttcgcaatactattctttttgtaaaatggacctcatcttcaaacacaatagttttttagataggagtgaagagataagcctgtgtatgcatattaaatggtatttttcctctggctatttccattggtcattaatcactcaaaattatataatattcttgtttttgtttccttttaagttttcaatgcactcatgttcttctcgtatttggggtaaacccctttataagttcgaaaatcgtcataacccgttcagttccttgtttatgtctcacatacctgtcttaacggtcatttcttattgtgtttgctgtctttcttgtttctttgatacttgtaaatcagtactatactgttcaacatcctga

SEQ ID NO: 595 - DNA, 1044 bp, Saccharomyces cerevisiae
atgaaggctatcaaattaacaggtcatgaacgtccattaactcaagtgaagtacaacaaagaaggtgatttactattttcatgttcgaaagatagctcggccagtgtttggtattcgttgaacggtgaaagattaggtactttggatggtcacaccggtaccatttggtctatcgacgtcgactgtttcaccaagtactgtgttacaggaagtgctgattacagtatcaaattatgggatgtgtcaaacgggcaatgtgttgctacatggaaatcgcctgtccccgttaaaagagttgaattttccccatgcggtaactactttctagctatcttggacaacgtcatgaaaaatccaggttccattaacatatacgaaattgaaagagattccgccactcacgaattaacaaaggtctccgaagagccaatccataaaattatcactcatgaaggtttagacgctgccaccgtggctggatggtcgactaagggcaaatacatcattgcaggccataaagacggtaagatcagcaaatacgatgtgtccaacaactacgaatacgtggattccatcgatttgcacgaaaagtccatcagtgacatgcaattttctcctgatttaacatactttattacatcatccagagatactaactcgttcttggtcgatgtatcgactctacaagttcttaagaaatacgaaacagactgtcctctaaacaccgccgtaatcaccccattgaaggaattcattattcttggtggtggtcaagaggccaaggatgtcaccaccaccagtgccaacgaaggtaagtttgaagctaggttctaccacaagatcttcgaagaagaaatcggcagagtacaaggccattttggtcccttgaacacagttgccattagcccacagggcacaagttatgcctccggtggtgaagatgggttcatacgtctacaccatttcgaaaaatcttactttgatttcaaatacgacgtggagaaggccgccgaagctaaagagcacatgcaagaagctaattaa

SEQ ID NO: 596 - DNA, 447 bp, Saccharomyces cerevisiae
atgcccaaatcccgaccaaaaaggaccattgcgtcttcctcgtcagttttttatggaagttcacctttccaaaatgatggctacatcaaagtaatggaactcgtatcacacattgtcattgaaataaatcattcacctaccgcaacaacggatgaaacgagaaagcagaataatccggagctgaaagtgaaagaaccagtttgtaacctcaagaagtgggaaaataacactaactttatattggaagatcatacgaagaataaaacaaaactttctagcacagataggatacgtaagtggtttagaagacatatattaaaggaagagatcgaaatcctttcccatggaaaacaattgagtagtattgatgaggattattgcccttcaaatgttcttgtaggatgttcaagagatctaaataaactcagatcatttcaaaatttttag

SEQ ID NO: 597 - DNA, 1539 bp, Saccharomyces cerevisiae
atgtccatgactatttgctcaaatactcctggtgcataccctgaaattggagcttataatgaggttgataaacagttggaatcaagcggattctcctctgattcctctctgatattgaataaaccagaagttcgtcaatactggtcatccgtttcatctcatatttcacgctcaggtgatgtgtttacaaatgataaagaaaaaatttcatcctctattggtgaggatgcgatggatatcgacgcttcgccctcattgattgaaaaatataactcttttcccacaagaaagattcttcctgagcaggacgagtttgagaacgacgttgaggacgatgcttcttcctcactgaaggaaaaatcacaaggttcttgtgaaattgaaattgcttctgaaatttcatccgaaattttaaatggcacatcggcagacggtaattccgagtttcacgacttcgctgagccccctccctctcagaatgaatctgtcgctctgtcttttagtcaatcgaatgatttggactttttgaataatccaagcggatcaggctcttcaaacgatatcaatagaagtacaagttccatttcacttcctagacatgtgtcactagattttaacgtttacaatagtctttgcctcacaaatgaggtgactgcatcagaatcacataatgtggccaaatttcaccttggcaagaaaaacaagaagagcttgctaccaagatggaaaaccattgaaatgtacggggaggtagttaagaaaactcaagacatatattctaattttcagtatgcacaatacattttaagggtagggttggataccgaaaaactacacgaacttgttaaggaactggaggatgaaagcaatagcttctctgtagattctttaaaggaatatttagtgaacgatgccaaagttattttgaagaaactaagtgccgttggataccctgatgcacagtaccttctaggtgacgcctactcctctggagttttcggtaaaataaagaatagaagagcatttcttttattctccgctgcagccaaaagaatgcacatcgaaagtgtttacagaactgccatttgctatgagtgcggcttgggtgtaaccagaaatgcaccgaaggcggttaactttttgacttttgctgcaactaagaaccatcctgcagcaatgtacaaattaggagtatattcgtatcatggtttgatgggtcttccagatgatattctaaccaaaatggatggttatagatggttgcgaagggctacatctatggctagcagctttgtttgtggtgctccttttgaattagccaatatttatatgacgggatataaagatcttatcatttcggatccagattatgctatggcattgtatgagaaggcggcggctttagggcatactgaatcggcaagaatactagaagacgctcgcagaagtggagggtttgtttcgcgaggacatcctccttcggcacagaaatatcataaaacctcccatgaagctgtggcagccaaaaagttgatttaa

SEQ ID NO: 598 - DNA, 1029 bp, Saccharomyces cerevisiae
atgtcaaatagtaacggtgataataagtatggtgtcattacaattggtgatgagaaaaagttccaagctaccattgcgccacttggtgcaactttggtagacctgaaggtaaacggccaatcagtcgttcaaggttattcaaacgtacaagactatttaacagatggtaacatgatgggcgctacagttggtcgttatgccaaccgtatcgccaagggtgttttcagcctggatgatggtcctcacaagttaactgttaacaattgtggtaacacaaatcacagcagtatcagttccttaaatcttaagcagtacaaggcgtcccctgttgagaatccttccaagggcgtttacgttgttgaatttaaattgttggatgatcacacacagcccaaccctaacgagtttccaggtgacttggaagtcacagtgaagtacactttgaatgttgcagaaatgactttagacatggaataccaagcacagttagttcgtggtgatgctactccaattaatatgaccaaccactcgtattttaacttgaacaaagtcaagagtgagaagtccattcgtggtacagaagttaaggtctgctcgaacaaatcgcttgaagttacagagggggcattgcttccaactggtaagatcattgaaaggaacattgctacttttgattcaactaagcccaccgttttgcatgaagatactccggtctttgattgcactttcattattgacgctaacaaggatttgaagactacagattctgtgagtgtcaacaaattggttcctgtttttaaggcctatcatcccgaatctcacatcaaatttgaggtttcgacgacagaaccaaccgttcatttgtacaccggtgataatttatgtggcaaatttgtgccaaggtctggatttgccgttcagcaaggtagatacgttgatgctatcaaccgtgatgagtggagaggttgtgttcttctgaagcgcggcgaggtatacacttcaaagactcagtacaaattcgatatttag

SEQ ID NO: 599 - DNA, 4308 bp, Saccharomyces cerevisiae
atggccaaaaaaacgaaaaataactcaaaaagttcaactccagtgaatgatgtaccaacaactgctggcaaaaagaaagcaaaaggaaaaaagggacaagaaccagagccagaagatgacaaaagggccaagcaacaaagtaatagagcaaaagtgacatccacagcaagctggacaggtaaattgcctcatacaatcttacacgaaacatgtcagaaacgaaaatggaataaggtagagtatgatatgaagaaaatcggtgataaaggtttcattgcaattgcagttttgtcattcactgacccaaagacaaaagaaacattgactgcaagaatgaacgatccaacctatgacaaagcttcaggaaaaggccttgtaattcctcaagaaactccaattgaagctagacacatggcctccactattgcgctatatcgcattgcatacaacaccaacctgcacatgatgcttccgccaaaccatagaaaaacatggtatgccctcgacgattttcgaaaagataacctgaaaacagacgaaaagcgtataaacaaactatttgatcttgatcccttcaagacaatggtggaagacagaaagctcaaagcccaacgtgaaaaagaacaagtggcccagaataatcaagcacagaaagaacaagttgcacgaaccattttatctagccatggtggaatttcttcttctggaaaggacaggcaagagagaaaagtagcatctcataaaaactcacataatccttcattagtgcggtttccaaaaaaggtttgggaaaattctatatttgttgaccttgatgaatcgtctagacaactgatagaaacttcattgaaagagaaaattgattggcaagctaaaaaaattagccataaaaatgagacaattgctgaaaatcgggaagatctcaaggcaaaattattaactctacaatttagaccaaaacacgtagaggaagccatgctttataaagatccattgtctttcttattgtttaacttaccggaagatgatttaccaccattttttcataaaaagaaaggtgatacaaaaaacaaggttgaaataacaaacctaccgttatcaactagaatgatcgttgagcgtttaacagaaattggtgtctcttcagatgaagccttattggctttacaacaaaacgatatgaatgaaaatgaagcggccgggttcttgacgagggaaattttaccaactttaaatagcaatacgaatgaacctgtatcagaaactgaatctatagaatgttggaaccaagagctagagagcctagagagcatttatgagggctgcgtgatggacgccaaggaagattcacactacacgctcaatttaattgaaaaactcaaaataaaattgaaagtatatagaaccaaaaattatcctgcatcattacctggtattgtagtttcaacctttgataaaaattacaagctacctgattatattaagaaacaaatattaaccaggttactgcattatctccaggaaggaaatctaataggcgatatgttagtatatcatatttatgaatggttgaaagagaatatatctaagataattgacaaccctggcccattaattccagattcagattcgaaaggtgcaataaacaaaagaaacatttcaaacggtaagagaagtataaataattctagttcgagaaaattcacaaaaaccaccatttctgaagacacgctctctgtcctaagggaagagtacacaaaaaggatcaaaagttctgaatacaaaagtatgcagttagttagagaacaactgcctgcctggaagaagcaaaaggttattatagatatcatcaataaaaacgaagttgtattgattactggtgaaacaggttcgggtaaatccactcaggtcgttcagtttatactagatttcttacagaaggaaaaaggagatttcggtaagactaaaatcgtatgtacgcaacccagaagaatctcggctattgggcttgctgaacgtgtttctgatgaacgctgtgtaacttgtggggaagaggtaggttacgtaataagaggtgtcaataaaaccaaagcttccacacgtatcaagttcatgaccacaggtgttcttgttaggttgttacagaatgctagaactatgttagaaaacacaattgttgttattgatgaagttcatgaacgttctattgatactgacttgatagtgacattgatgaaaaatctcttacatagagttcgcggcatgaaaattgttttaatgagtgctactgttaacgttgacttgttcaaaaaattctttccggggctagcaacatgtcacatagaaggacgcactttccccatcactgattacttcttggaagacattcttagtgaccttgacttcaagatcaagagagagaaggctttgtcttatgatgatgatagcgttgatgaaagaaataatgacgaccaatatttgaagccgagagcagattctaagttttttacatctgggcaaatcaattatgatttgctttgtcaagtggttgaatatgtacataaacgcctgaaagctgctaatgacaacggatctattatcgtttttttgcctggtgtgggagagattaataagtgctgcaatttgctagctaataaatcaaatgaagcagattttatggttctacccttgcactccgctctaactcctgaagaccaaaaaagggtgttcaaaaaatatcatgggaaaaggaaagttgttgtatccacaaatattgctgaaacatctattactatagatgactgtgttgcaactattgacacaggccgtgccaaatcgatgttctataatccaaaggataatactacaaaactaattgagtcgtttatttcaaaagctgaagttaaacaacgtagaggtcgtgctggtagagtacgtgaaggtttatcttacaaattattttctaaaaatttatacgaaaacgacatgatatcaatgccaattccagaaatcaaaagaatcccgttggaatccctttatttatctgttaaggctatgggtataaaggacgttaaagcgtttttgagcacagctttggatgcccctcctttaccagctctgcaaaaggcagaaagaatattaacaacgataggacttgttgatgagtccgacaagtcactcacacagctaggtcaatttattagcctgatgcctgtcatggatagtaagcatggtaaattactaatatacggcattctgtttggctgtacggacatttctgttttacttgtctcgatactcggtattggagttttgcctttcatcggaggttttgaaaatagggaaaagataaaaaaactgctatgtaaatatgaaagtcgtggggatttatttgcagtattggaaattgtcagagattacttcaaaatcaaagattcgagcatcaaaaggaaatatttgagagacaatttactttcctataataaaattaatgaaattaagtcatcaacagcccaatattattctattttgaaagatgtaggctttctaccaatggactataaagttggaagcatttctgatttgaataggaacgagcgaaattttgatatcctaagggccattctcacgggtgcgttttatccacacatagccagggtgcaactaccagatgtaaagtatctatcaacaagttccggtgctgttgaaaaagatcctgaagccaaaatgatcaaatactggattcgaagcgaagagtatcaggacaaattagaagaatataagacgaaaatttcgcaagagacgcaaaaggttgatttggaagatttaccgttacctgctactagggcattcattcatccaagttcagtcttattttcaaccaattcagtaaacttggaagacgctaagttactctctgaggtggatggtccaatatcccgtcaatccaaaataccaaccgttgtaaaatacccatttgttttgtttaccacgtctcaagttactaataagttgtatttgagggacttaaccccaactactacattatcattactattattcggaggggcaatctcttatgacattggaggtactattcattcaccgggcatcgttgtcgacaactggctcccaattagaacctggtgtaagaatggtgttttaatcaaggaactgagaacacaacttgatgaggccataaggaaaaagttagaaagtcccgattatgctaaaaaatctcaaattgataattctggtgctgataaaactctaaaaattgttgaaaaaattatagcttccgaacaatag

SEQ ID NO: 600 - DNA, 3399 bp, Saccharomyces cerevisiae
atgatccaagaaagtagtccagatgccttagcagcagcagcagcaattggaaatgcgctcagttataatgggaggaccgttgacaagagtaaaataccgcaatacaatcagagttttacctctcgaactacgtcaatcgcagggattaataggtatacaatgctctcgaattctaggactaactcaaggatgctcttaatgaatggtaacgttcgccaatactctaagcgcacgtcgagtttgccaaaccaaggacataagaatacctctaataattcggcggggagaaggcaacacagggctcacgaggatgcagaaaccacgtttcgagaatttggaggcaagcagtcatcgaaggttttaaacatttcaagttcgactggtcagaatagtaaatcaaggaccacatcacttgggaactcaggcagcacaataaggacgataaaaaaatacataccaggccctagggggttaatggctgtggaagtacccgtggaagtagagcctcctagatacagtctgagcaaccgctcaaaccaacgaggtggtagagcatattctttgcctactcgaaacaacaaaactagtctaatgcataggaataaaactactaagaaagcaggatcacaagagaaaaaaagtgaaagcggcggtaaatcaaaaaacgattatcatggcaaagtattatctaaaatgcatactacatcattaaagcaacggcataacaatgttccattaataccaacaactatgaacgaggaaacggaacaagaactgcaagaggatcttcatgatcctttagaatttaaacccatgattatatccgatgacgaaaactcttttattgaacccagcgttctcgatcgtagcatacccaaaaaagataaaagtggtctcagtggacgtgagaaaaaggaagaaattgaaacattgcttaaagaggttcatagcttggaggaaaaaatatcaaatatcgaaatagcaaaattgaacgaagaagaaagggaacaaagcttaattttggaattgcgaaaagttaagctagatgaagaacggagaatggagttattgaaaagagagctaaatatagttaaggagaatgccgaccttgaagcccaagaattaaaactaattgaaagcaaaagaaaacaacactttcacaaaggacaggaagtagcatccgaggtcaaatcgatcacgattcgtcaacctactttatcagaacctaagcctgcctatgtacctccggaagacgtggagaaagagccatcaactctctccaatcaaactcagaatattgaaaatgcagagaatatcgattctgttgatgccgaaggaaatttagtagatcctattcttctcggctctttaaacaattctaacttccacatgaattcagataacgaagtgaggtgcattgcagattcaaacagtctcactggcagcgaattatccgattataattatatagaaggctcggcaactgatcttcgcgctactgcaaagacaagtgtggagtctgaaataggcggaaatcaggttggactaaaaattccgcaagatgatgatagtgaaaaacaggaagaacgtacaaagggaaaaaagtcaggcctcgtcgatacaaattgctttttagtccaaaaagaagatcaagaagaggcgctttccgataatgaaccggaaagttctgaaaaattccctagcacttctgggatcgagaacgttaaactggaggatgagactggtagtgttatggacaaaaataatggacccaacaatgacaaggacgatgatgatgacaaagacaatgataatgacgatgatgatgacaaggacgatgatgttaacgatgatgacaaggatgaaaatgttgacgatgatgaaaatgttgacgatgatgatgacgatgatgatgacgatgatgatgaatatcatgattcttatgacgtgataatgagagatccggttcaaatagaacaagatatatctgacgtgccttcattaaaacacccttcagaatattctaccgagacagaagataataaaaagaaggaacaaaattctgaaaatgcagaagttagtcagtccggaacaaacatggccaagtatttacgtggtgctaatccttacctcactaacacaagttcagacactttcagcctagattccgaaaacgtgaactccaagtcctccacggataccacaagagttgcacctgaccttttgaaaagctcactacaaccacaacttagatctgatttgaaacaatcagccgttccatcaagtacttcctcgtccatttattcgatagaaacgtctccaaatattgattcctctacagggaaaactgcttccaatacgaaaacgaacagccatggccctccgacgagtatttcaaaacagaaatacgatcaatctagttctcatcaaatacccgtgatgtctcccaagcgtctcgacgataaaagaaaaatcaccaatcgttcgtgcctaagaactctacgtggtagttcaaatgaggctactctttcgcataatatagtatatccagcttctgactcatcttcatcccctccatatcatagcaagaagccatcaaatcctccatcatctggcaacttggcttcacacgaggcgtccaagtgttttccaaaagctcctcaggcgagcacaacatcgagacgattgcctgatcatgtccctctatacattgataaaaataatagtgcactctaccccaaagaaccccccgccaggaagtctagttttgagaaggaaagacctgcgaaggataacctaggatttagaagcatgtctttgagagagccacttatcacaaagaatgctacagccacagcagcagagaacctggatgtggaagaaaagaaggaaaaaggaggtcatgtctcaagaaaatcatggacttttggtttgccctctccgctgaaaaggagaacaagtcattctactcataccacgaacgaaacagagatagttaatcccatgacgaacttcaaaaataagaccaacgaaaacgatatgccaatattagcaaataaaaagagctgcaacaacgatgattcttccccttacactgcatcatccatgaacactaatgacgtaagcgaagctggtacagaaggccaccggttttcattattcggaaataaaagccaattgtcaaataggaacatatctggtggaacagccactttggagtcatcaaatcctgacctgcctacagccttaccattaagcgttccggtgactatcattgataaaaatggagagatacacaagcttcataacgatgatgcagctataaaagataagtcgcatgaccgtcacggtcacagtaaattcggtaggaaactgaaaaaaatttttggcaggaaatga

SEQ ID NO: 601 - DNA, 1431 bp, Saccharomyces cerevisiae
atgatagcttccaaaagctccttattagttactaaatcgcgcataccctctctatgctttcctttgataaagaggtcctatgtgtcaaagactccgacacactctaacacggctgctaatctgatggttgaaactccggccgccaatgccaacggcaatagtgtgatggcacctcctaactcaatcaattttctacagacacttcccaagaaggaactattccaactgggattcatcggtattgcgaccttgaacagcttcttcctgaacacgatcattaagttgttcccttacatccccatcccagtaataaaattcttcgtctcttctttatactgtggcggtgagaactttaaagaggtcatcgaatgcggcaaacgtctgcagaagagaggtatatcgaacatgatgctttcattaactattgaaaattccgaaggtacaaagagtttgtccagtactccagtagaccaaattgtcaaggaaacaatcagctctgtccacaacatcctactgcccaatattattggccagctggaatctaagccaatcaatgacattgctccaggttatatcgctctaaaaccctctgctttggtcgataaccctcacgaggttctgtacaatttcagtaatcccgcctacaaggctcaaagggatcagctgatcgagaactgctctaagattacaaaagagatttttgaactaaatcaatctttgttaaagaagtaccctgaaagaaaggccccatttatggtttccactattgacgctgagaagtatgatttgcaggagaatggtgtttacgaattacagagaatcttatttcaaaaattcaatcccacttcatctaaactgatatcatgtgtcggtacttggcagttgtacctaagggactctggtgaccatattttgcacgaattgaagctggcccaagaaaacggctataagcttgggctgaaactggttcgtggtgcttatattcattctgaaaaaaaccgtaaccaaattatctttggcgataaaacgggcactgacgaaaattacgatcgtatcatcactcaagttgtcaatgatttaatcatcaatggcgaggattcttattttggtcacttggttgtcgcctctcataattaccaatcccaaatgctcgttactaatttgctaaaatctacccaagacaactcttatgccaaatcgaacattgtgttggggcaattactaggtatggcagataatgttacctatgacctaattaccaaccatggcgctaaaaacataatcaagtatgtcccatggggcccaccattggaaactaaagattatcttttgagaagattgcaagaaaacggggatgctgtgagatctgataatggctggccattaatcaaggccatagcaaagtcgattccaaaaagagtaggcctatga

SEQ ID NO: 602 - DNA, 2373 bp, Saccharomyces cerevisiae
atgaatcattggttagcatttttgaataagcctgaatccctaaaggaacaaaactcggattgcgaccagcagggggagatgagacatgttactgatggcactttaactaagtctccagaaagtaaaccttttcgagagcggcgttcacaaacttggatagactctgaagtacctacgtccactgaaaaatctaatgtgcaggaaagtatttcttctgatattatatcaaaactgtcgaataggcgttcccgaagaaaccgctcagagagttgggcaggttcagaagcctcttcaccttctggtaacattagtacattggaaaatgctacggaaaaaaatactttaaaatcgcctaataaatttctacaaaggggtggtttaccaactgtaggaataggctcgcaggctctgtcacctgcaggaaagcccagtacattaggaaatgtaagccctggtaaatttaccacatacaaagtacacaatagtattgaagtgaatagattttcttctacacctacaaagctcctcacgaatccccacaaagtcgcagcaatctcaaatgatgagcattatgttgtaagcaatgagagtctggaggagaatatagaggttgcgcatctagagaacgtatttcgctcatctaaaactccagatgaagaacagtccgaatatatgaaattaggagaaattaggctatcttcttcatcatatggaggaagtatttctaaagaaaatagtttacccaaggtattagatgagctccagtcccaaaatgaagagatcaaagcactaagacaaaaactagaagagaaggatgacaggattcaagaactagaagaacttaatagcatgaatgatgctaaacttcaaagaatagaagacttgcagaaggaattccacaacgaaagaaaagctgcatcaaaaaggctcaacattgttcaggaccggtttcgcaaagaaattaaaaaaattagagaagaaaaaattacagactttcaaaacaaaaacgctagcaagaaggagaagaatgaagtgactagtgccaaaactaaatgtaaagctttttctcaaagaaatattttagtttcggaactatacaggaagcaaaaacaaatcctaaacttgcagcaagaaaatgataaatttctaaaagatattaacgaatcgaataactctatagtaaaattaagatctgaagttgaaatactgaaaagcaatttgcaactttctcaagatgaaaataaaaaattacatgataatggttcgttttacgagaaaaggttaaatgatgtttacagctatatgcaaaatctttctctttttgagaaagaccttggtaaattcatactagaagaaatgaaatgtggccattccccttcgatgtttcaaaacggttttgccaagctttatccggattttcaagatatcaaaaatcttgaaaatatggagcaatacaaacaattaaaaggaaagatagaacttttggaaaagaatgaccgtatacgtcttgaaaaaatcatttctgtctttaaattgattaatgaaagattacattttatgcaacagcagcacagtcacaaaataaaatatcttcaaaaagaggcgttaacaaaagaacaacaatttcgtttggaaaaaaggagatggcatgatatcctgaacctcaaggaagaaaactttcaaaaactgaagagcgagttaaaaggaaaattaatactaagtgaaaaaattcagaaaaatgccgaagataaattgaacgattacatgaatgaacaccaggaaattgttgagaaacttcagaatcaggctttgattgcttcaagatggagcactcaaattcaagagtcagaaaacacacataagaaaattactgacgagttagctggaaaacaaagtgaaatattaaaactcgaagaaacaattctatcactaaaagaagatgtattccaagagaagctgaatttaaaaaaactatatggtgatccttctaccgaacttaattttgaaactgttggaaaatcttttccacatataacgaaggaaaagtacgactccttgggtcttgatattctgacagaccttacctatgtgcaatcgcaaaatctaatcaaaaatttattaattgtgttggatatcccattaaaaaccttcttaaaaattgtaccaacaattgtcattcaacttagatgtgagcttacacttctcacaaaatttgctaatgatttgaaccttaaggtttttggtaaacagttagatttcaaaagtagaagaaaggtcgcaatgaatgagtttttgaacaatcatgatattgctgaagtaaagcatcctcttgagtatgatttgcaagcgttgtttaaatatttcttttcttag

SEQ ID NO: 603 - DNA, 1542 bp, Saccharomyces cerevisiae
atgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatatgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaagtagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttga

SEQ ID NO: 604 - DNA, 921 bp, Saccharomyces cerevisiae
atgaatcaaatctggtctacaggtcccccaaatttttacttcaactctgaatggaaagaaaataagagaaatgacaggacaattgaagactctttaagagaactagatgggttgatccattccttggagagaactcatattgaagtacaaacaaacccaaagctaaagaacgatgtcacagctttaaatgatattaacaagaaagaaaataaagaagagatcactcatgaaaactatacacaccagattaatagtattccattgacaagctcaaatttaaatcggcatttctccttttctagagactacaaccaatctgataatagcaataataattattacagggaatatttatccaaaccaaggtatttgcagcagtcaactaaagaacaaactttcaatgaaattaataaaagaaaaagtgctgcaattattcccccttggttaaatattccagaaaactcaagattttttgtaataaagtcctcgtctttgaagcatgtcaaaaggtcgttttacaacggaatttggtcgtctactcatttcggcaacaaaaggctatctgaggcatataaaaagcttaattcgggagccaaagtgtttttatttttttcaatcaacacatcaggaagattctgtggcgttgcagaaatggtatcggatttgaaaatggatttggacaccagtatatgggaagatgaacaaaaatatggcaaagcctttaaagtaagatgggtgatcgtgcgtgatataaataacagatcgttaaaaaggtttttgataccatccaatgaaatgaaaccgataacacattccagagatactcaagaaattccatattcgattggaatttcaataattaatctatttaaaactcaagattctgatattttctccttcttggatgagacgtatgaatag

SEQ ID NO: 605 - DNA, 354 bp, Saccharomyces cerevisiae
atgtatatatatgttgaagtgtgtacacacgtacacgcacaagctacagacgccacgcggcccggcattcatatatgtacatacatttatgcacatatatatatatatatatatgtatatgtaaatgtatatatacagcttgtgatttcgcgcgccgaatgggctgaaaagcacagtatagtggagaagaagagagaggagaaggggagaggggcaatagcaatggatgtggtagaatacagggaaggccaagctgttgttcaatggatgcggttcgaggcccagcgcaaggggggcgcttcgaagcatagaacattatccgcggaaacgggtattaggggtgagggtgaataa

SEQ ID NO: 606 - DNA, 558 bp, Saccharomyces cerevisiae
atgtcgtcgtatttacgtcactgtagttctcgactccccggaaaaacctgttcgcgtgagcggaacaactttccattgaggcttagtggaggtatttccggagagggcattcatcccggatttcctattagaatggtgcagtacgccgccctcgcgctctctacatgctgttttagcgcgcgtgatatggacatagatgcaccacgcggtgtttcttttctaggcatcaagtggcttgcagccaatcaaacacgaggaatgtgggatggaagtacaatctcctcaccgcacacccacgttttccgggacatttctcggacagactctttttttctttttttttttttttttgcttcccacgaaatcggaacttatctatcagccgaagaaagcgcgttggacagatacttgagcagattttgtggggagagagaatcttgggacaaatgcaaaaaagaaatggtcggaacaaaagggcagtatacagggccggcagtaccttctgttcctaccacaaaccttaacgatatcggtgaccctactaaaactgtgcaatag

SEQ ID NO: 607 - DNA, 315 bp, Saccharomyces cerevisiae
atgctgacgaaagttgtgttcctctttttttggagcaggtctgactcaactaaaaagctagctgcatgcaaccacgctacattggcacactatatcctgacgcccgcgctatactctgacgcctgcgctatatattctgacgtctactccataactattatagtagtggccactgttgttcgtaacccggcgcggtgttcgctccgagcacgaaaattctgtcgtttattctcttccttcttccagttccattacttaaaggagctgttttatttcattcgaaagcccgatgacaaattctcctctttcatataa

SEQ ID NO: 608 - DNA, 4779 bp, Saccharomyces cerevisiae
atggcattttggttacctcaaaatatacaaaagcggctgcttctttacgtccttcagcaaatttcgctgttctccaatatagatttatctaacttggacgtttctatagggtctaagtcacatttctcgttccatgatgtgaatctgtcacttgatgatctcaacattccaaacgtgcaaataaacgaaggcatagttgacgagcttgtgttaaaattaacagtttctggcggtgtggaaatcgatgggtctggtttaagatttatcatgacacctttatattccagtggctcacaggaacttcactcagattttttggttaaaagcatccaagatcttacgaattcgatgttacaatttagtgatccattgaccacatataataggtacaaagaagatgacattagctcttcagacagtagtagtgatctcaactctaatatagaagcttcaaaaccagccgcaaatggttcttatactcttcaaaatatgcggaacaaggcccttaatgtagccttagcgaaattgaaaatagcattaaaggacgttaccatacgtttcatagtgaatgatagagatccttccgataacattgtggaggttcatctagaaagcatacaacttattactacagacgcaaatttacgacatataaacattgaaaatatcaccatttcctcaatacaaaaacaagctgtacccgactctcctgtgcatcctttcaataatgacgatctgtcacaaagcgtttatttatcaaaaatggaggctacttcactttatatgagcgccatggaagagcaatcaaatgaagaccccagtgaaccccaagttacacaagaagaacaagagaatgataagtgcaaggaatctttaatggaaataaataatttgaacatagcttttaagggtttatcatcggtcaatgatctcagaatgtctaatattgttattgatattcaggatgttcatttagcgatacacaaaattgtcgaaatcaaaaactccactttgaagaatattatagatatcattgttacacatttggatgccaatgaaagcttttcttgccaggattcccaaagtccttcacctgacaagcaggaaccatcagctctttcttctgttgatatcaaatgtatatacttaaacttaggccaagatatcacagtaattttgaagagctttaaattagagcaaaaggaaaataattcattggcattttctttaggctcattttattctaattcgagtccattgacaattagccataaaactaagccattgctcactggagaacaaacccctcaaagcatcgcattaaatatgggcgacgaactagatattattatcagtcatgatggcattgcgcatttctttaaaatctttcagtttgtttcaaaatgtatgtccttttatcagaataagtcaaaagggatgatgcctcaaatagcatcggatactaaaaggaccgtacaacttacctcaaaagcagtgaagttgtcgcttaagtttccatattttttattatgtttccaggtttcacccttcatttacgactctaaccgtgagttgtacattgagcttgtagacgtatttaaaaaactaccttctcggtgcacgaaaatattgacaatgtcgagcattacgatctcgaacttgcaatcccctctacaactgggttcatatgacgatactttgaaagaagcgctaatttatagttctgtccatgcaatcatcaaagaagtgatatttaacgaagaatattctggaatagtacaattagtcgaagatatttctgcgtttggaaaacttttcacggattcaaagaacagtgaatgtacaggaaagtctaaaagcaagagaggctcctttttgcagagaagtgtcagagtacttaattcttccaggttcgtttacaagcagagtttatccgctaatttttctctcaagatagattccatgaagttaaaagtatcagaaattatagggccgcaatttggttctgtggaagcattactatcaaataatttctttgcgattacggatgactctcaaattgtatattttacaaagaacttaaaggtagaaagaaagacaccgtcattattagagccacaagaaatcatgtcagtagttttgaataaagcagttaacgaacctgtactatatgttcatagaagggcgaatggaaagttaaaagtcatttttaacaacattcgcatacattactatgcaaggtggttagaaatactaaagaaaaacatcggcccggataatgccagttcaaaagatgaacctgtttcacaaaagcttagtaaaaaacaaccgacttcaggatttccctgggaactcaaatgtctggactgctctctaattctgcaccctttcagattaaaaagtgtaatggtcattgtacttgacaatctaacaactggtggaagttcatttattccgcaggcaaagcttctttcaaaggcgaatacactcttcctaatagatgactatcagaatttcaaaattcaaaaagataagaactggcctagtttgataaatttttatgctggtcaaggtttctctgcaatcggtaaaatagatactttgaattttttaataaacaaatccgatggtgcccttttattggattgtaaaatagaacaagttggtctttcattatgcgcggattcttttcaaactttttgtcagctttgtattgatttaaaatatcctcagacgtttcctgatgaggaaaaatttagaacgcagttgaaaaatcctatcgatgtattcaaagacatcgattgtgatcttttcaattctgccttcatccgggagaacaatcatcaaaatgattacgactcagtgcatttggtagacagttttctcgacaaaactcacgagttcaacaatggtgccagaagtaaactatcctctcaaggttcatatgaaatggacagttcctctggaactgccacaggtggtattttacttccccatgagagttatctagactctgctcagccaaaagaagaagatactccaccaatcgcctcaaaagagcaagaaagggatgtggatataaggggtagtatagatgtcgaaaaagttgttataaaactattcgatgggtatgattggaaatatacgcggaaatttatcgctaatactgttgaaaaactggataaagagctcagtaaagcggaagcaagcagttcgaaatcaaatgtaccccaatcagaggcaaatatttttgactctatttatatatctgctaacaaaaacaatgtcacagatttgagaagaaatcttgatggtgagatccagggggttcagaattccttctctgatgtctctaaagttaatttgcgaccttctaagcattacaaagccctgattcaattgaacaaagtacatgtcaatttgaagaattatcgagtagatgaacccgatgagtctaactctgataattccacagatgttttgaaccgatgtgtagtttccatttacgaatttgaaattatcgataatgttcccacgtccacctggaataaatttgtaactttgctaaagcacgaaccgtggccacacagttctccgatgtttcttctggacctggaatttatccggccgatcgactttttgcaagcagtggaattagtcatgcaattaaatgttgcgcctttacgccttcacgtggatcaagacactttagagtttctaataaggttcttagggttcaaagataaaagatttgaattaattgatgagtatccagatattgtatttattcaaaaatttagcactaattcaattaagttaagattagattataagccgaaaaaagttgattatgcgggtttaagatcgggccaaacttctgaattgatgaatttttttacccttgatggatccaagattattttgaaaagcgtagtcctgtatggattaaatggattcgatgaattaaataataaactgaaagccatttggacgccggatattaccaaaaagcagctgcctggcgttttggaaggactggctcctgtcagatcgtttatggcgattgggtcaggggtgaagaccctagtcacagtactaatgtcagaatacaggcaagaagggcatttgggaaggagtctgaaaaagggtggcaatgtcttcttgaaaacgacaacgggagattttgtgaaattgggagttaaattaacttcagggacacaggcgatattggagaacaccgaggaactattcggtggtgttggttccaatggcagggtgtacgatgcatcgaaatttggctccgctgatggtgcagacagtgatactgcagctgtattagacttggatactttattcgaggaggatcagttagttggtagtaaatattccaggataagagatcatgagcccacggcagtagtcatcgatatgtcttcaccgggagatcacaacgaacccacaatagtgagtctgtacgcagatcagcccctcgacctgcccacgggtttgaaggaggcgtatagttcattagaaaagcatatgcatattgcgtacgatgcggtatggagggcaaagggacagatgaaggatgataaacggggagggccgagcgccgcagcagtttatgttgctagagctgcacctgtggcaattattcggccgttaattggggccactgaggcagtgtctaagactttacagggaatagctaatcaagtggataagacgcataacgagcaaatcaatgataagtacaagtccaatcggactgattcgtaa

SEQ ID NO: 609 - DNA, 1383 bp, Saccharomyces cerevisiae
atgcctatcaatgccatcacttccgaccatgtcattatcaatggtgcaaataaacctgcgactattgtgtattcgaccgaatcaggcacgattctggatgttttagaaggctccgtggttatggagaaaactgagataaccaaatatgaaatacatacgctggagaacgtatctccatgtacaattctgcctggacttgtggactctcatgttcacttgaacgagcccggtaggactagctgggaaggattcgaaactggaactcaagctgctattagtggcggggtcacaacggtggttgatatgccgctaaatgctattcctcccacaacaaatgtggagaatttccgaattaaattggaagctgctgagggccaaatgtggtgcgatgttgggttttggggtggactggtaccacacaacttgccagacttaattccgcttgtcaaagctggcgttcgcgggttcaaaggattcttgcttgattctggtgtggaagaattccctccaattggcaaagaatatatagaagaagccttgaaggtcttagccgaggaggataccatgatgatgtttcatgctgagttgcccaaggcacatgaggaccaacagcaacccgagcaaagccatcgtgaatattcttcgtttttgtcctcgaggccggattctttcgaaatagacgccatcaatttgattctcgaatgcttgagagccagaaatggaccagttcctcctgtacatatagttcatctggcatcaatgaaagcaattcccttgatcagaaaggcacgtgcgtcagggctaccagtcacaacagagacttgtttccactatttgtgtattgctgcagagcagatcccagacggagccacctactttaaatgttgtccacccatccgctctgagtctaatcgccaaggcctatgggacgctttgcgtgaaggtgttataggctcagtagtgagcgaccattcgccatgcacccctgagttgaagaacttgcaaaaaggtgactttttcgattcttggggaggaatcgcttccgtcggactaggtttgccattgatgtttacccaaggctgctctttggtcgatatcgttacatggtgctgtaaaaatacatcccatcaggtaggactatctcaccaaaaaggcactatagctcccgggtacgatgctgatttggtggtatttgatactgcaagtaaacataaaataagtaattcaagtgtctacttcaaaaacaaattgactgcctacaacgggatgacggtcaagggcacagttttgaaaaccatattaagaggccaggtggtatatacgaatgccaacggagtctcgaaaacaccattgggtcaaactttgcttgattctagacgttaa

SEQ ID NO: 610 - DNA, 393 bp, Saccharomyces cerevisiae
atgttcaactgtcttacaaagctcgtgatattagtatgcttgaaatatgtagccaaagccttactaaaccgttccacaggcttaatcatgaaggataagcccgaaggggtccaccatatcaagtcgtgtagcgattcgtcctccagaatctggtatagcttatggatgaatatcgcattttgtggcggcctgggccccactagcatcttcgacccatgtttcttaacatcctcggcaccgtcgccgccttcagcaccagcattagctattccagctgctgctccaccactacctacatcggttccagccggggccggtgtagaagctggagctggggctgagaccgtttcctcttcactcatgattttttcttctttttttctatataactga

SEQ ID NO: 611 - DNA, 804 bp, Saccharomyces cerevisiae
atggccttgaacgataatcctatacccaagtcagttcctctacacccaaaatcaggtaagtacttccataatttacatgcccgagacttatcaaatatatatcaacaatgctacaaacaaattgatgagaccataaatcaattagtggattctacatctccttccaccatcggcattgaagagcaggtcgcagatattactagcacctacaaactcctctcgacatacgaatcggaatccaactcatttgacgaacatattaaagatttaaaaaaaaatttcaaacaatcctcagatgcctgtccgcaaatcgacctttctacctgggataaatatcgtaccggagaactcaccgctcccaaattatctgaattatatctaaatatgcccacaccagagcctgcaaccatggttaataacacagatacactcaagatactaaaagtgttgccgtacatatggaatgatccaacttgtgtaataccggatctgcaaaaccccgcagacgaagacgatctacaaatagaaggtggtaaaattgaattgacttgtcctatcacctgcaaaccttacgaagcaccattgatatcaagaaaatgtaatcacgtcttcgatagagacggcattcaaaactatttacaaggatacacgacaagagattgcccgcaagcagcgtgttctcaagtcgtttcaatgagggattttgtaagagaccctattatggaactaaggtgtaagatcgccaagatgaaagaatctcaggaacaggataaaagaagtagtcaagccatcgatgttttatga

SEQ ID NO: 612 - DNA, 2448 bp, Saccharomyces cerevisiae
atgtctgagactctgcctagatctgatgatttagaggccacttggaactttatagagccaggaattaaccaaatactgggtaatgagaaaaaccaagcatccacgtctaagcgagtttacaaaattctttctccaaccatgtatatggaagtctataccgcaatttataactactgtgtgaacaaatcacgctcgtctggacattttagtactgacagtagaactggccaatcaacaattttggttggcagtgagatttacgaaaagttaaagaattatttgaagaattacattttaaattttaagcagtctaattcagagacctttttgcagttttacgtcaagcgctggaaaaggtttacaataggtgccatttttttaaaccatgcattcgattatatgaatagatattgggttcaaaaggaaagaagtgacggcaaaaggcatatttttgatgtaaacaccttgtgcttgatgacatggaaagaagtcatgtttgatccgagtaaagatgttttaataaacgaattattagaccaggtaaccttgggaagggaggggcaaataattcaaagaagtaatattagcactgccataaagtctttagttgcactaggtatcgatccacaggatttgaaaaagttgaacctaaatgtctacatccaagttttcgaaaagccatttttaaagaagactcaggagtactacacgcaatatacaaacgattatttagagaaacactcggtaactgagtatatttttgaagcacatgaaatcatcaaacgtgaggaaaaagcaatgacaatatattgggatgatcatacaaaaaaaccactatccatggcattaaacaaggtcttgatcacagaccatattgaaaagttggaaaatgagtttgttgtccttctggatgccagagatattgaaaaaattacttctttgtacgcactaatacgcagagactttacattaatcccaagaatggcttcagtgtttgaaaattatgttaaaaagacaggtgagaatgaaatttcgagtctactggcaatgcataaacacaatattatgaaaaacgaaaacgcaaaccctaaaaaactagcactaatgacagctcactccctttctcctaaagactatatcaagaaattactggaagtacacgatatattctctaagatttttaatgaaagtttccccgacgacatacctttagctaaagctctagataatgcgtgtggtgctttcatcaacatcaacgagttcgcattacctgctggatctccaaaaagtgccacctcgaagacttccgagatgctagctaagtacagtgatatactattaaagaaggccaccaaacctgaagtggcaagtgacatgtcagatgaagatattataacaatattcaaatatttgaccgacaaagatgcgttcgaaactcattatagaagacttttcgccaagcgtttaattcatggcacttcaacatcagcagaagacgaagaaaatattattcaaaggctgcaagcggcaaatagtatggaatatacaggcaagataactaaaatgtttcaagatattagactttccaagatcttggaagacgattttgctgtcgccctgaagaatgaaccagattactctaaagcaaaatatccagatctacaaccatttgtattggcagaaaatatgtggccattttcataccaagaagttgaatttaagctacccaaggaattggtaccatctcacgaaaaattgaaggagtcatacagccaaaagcataatggtagaatattgaagtggctatggccattatgtcgtggcgaattgaaggcagatattggaaaacccggcaggatgccgttcaactttacggtaacactgtttcaaatggcaattttgctactatataacgatgctgatgtattaaccttagaaaatattcaagagggcacgagcttaaccattcagcacatcgcagcggcaatggtaccattcatcaaattcaaactgattcaacaggtcccaccagggctagatgctctcgtgaaacctgaaacacaattcaagctatcacgtccttataaggcgcttaagaccaatattaatttcgctagcggagtcaaaaacgacattctgcaatcgctatccggtggaggccacgataatcacggtaataagttaggaaacaaacgcttgacggaagacgaaagaatagaaaaagaattgaatacagaaaggcagattttcttggaagcttgtattgtgagaataatgaaagcgaaaagaaatctgccacatacaacattggtcaacgaatgcattgcgcaatcacaccaaaggttcaatgcaaaggtttctatggtcaagagagccatcgatagcttaatacaaaagggatacctacagaggggagacgatggtgaatcgtatgcttaccttgcttaa

SEQ ID NO: 613 - DNA, 1395 bp, Saccharomyces cerevisiae
atgccagaagatacaagctatagcaactccttcgaggattattacaacaattctcacgcgatttccccttacaaggattcattttacaaagaaatgacaccatctaagccaaatgtaaggtttggtgatgatgatgttaacatttttgatcaaagaaaaaaagtaaatgaaatcaacaagaataacaccgtcaaaaggtcgatcccatcatcgataagcaccactattacccccaacaagtctagcttaaagtcaccaaggggaaaaagggcttcgaagaattcttttgataatgaaactaagttagaatcgaaaaatgaaactctgaaagaggtcaatgacgcggttaaccgttgctatgcgctttgtaacattccaactaagcatgtatccataaatagtatttctgatttggcgcagacgttcgaaacgcttgctgtagggataacccatgaaacgaacagaaaagctgagtgtgaacggagcaagaatgcaatagattcactttactaccatgaacagctagaaaaaaaagaacttaatgaaaaaagccttcaaatggcaatcgatcacttgctgaaggtcacaaagcaaaatttgagacaagctgacgatggaaacaaactgaaagaaacagaagcactcaaaagtttcattgaggaaatagaggaagttgacgataataagatttccatcaacagtttacaacaacagttgcttgaagaaaaaacggcaaacaacattttgcgaagggattattataaactccaggaacgtggaaggcgtttatgtcacgagtttcaggagttgcaagatgattattccaaacaaatgaaacaaaaggaatatgaggtgcaaaaactcaagaatgaaattaaagttttattaaacatgaacgataacttaaaggcagagaaggcccattactctcagaaagagaaacaatattttcaaaaatatacctatatagagaaatacatgaatcatgtcaaggaagagtataatagaaaagaggacgaatgcaaaaaattgaactttattattgacaagagcatgaaaaaaatagaacatttggagaggtcgcttcagactcaatttaccgctcaaaacagcttctcaactgcaatgatccaagaggaaggcccgaaagatgcccatttgaaggatcgctatcacaaagtcaaagagtttatggaacaaaagttgcagacttccaaaattaatgacccctcttgttctgaggcagaggcacttgataatgtactttgcttaatcgaaagcagtatgaaaacactggacaaaaatagtaaatgttatccaattgcgacaaaaaagtgcataaagtatgttactgactcaccaagacttaaagaaaatgaacacgttacaaattga

SEQ ID NO: 614 - DNA, 2013 bp, Saccharomyces cerevisiae
atgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatctggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctggtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatacggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattctacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtctcaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatga

SEQ ID NO: 615 - DNA, 1227 bp, Saccharomyces cerevisiae
atgagtagaggcaaactggaagatatggaacaaaaggaaacatcggaagttgactggataatctgttttgctttaattcaatccaggaatcctacgttgtggaagagggcactttcaagaaagaaaggagatgtcgaagatgtaggtgctctcaagagtgaaaaaaatttaaaaataaatcctcgggaaaactcaaaacatatatacaaatgggttgcgcctttcgaaaatggatttttgaataataaatcactgtttgctcatctggaacctatatacaatttcctttgccagaataagtacaaaagcttcgaagatgcagttggtttaaaggagctgcaatcatttagcaaagatgtatcaactgctgatataaacaactggtttttaccgagatataaaattctgctaaaaatcctgagcttaaaaacaaaagaaattgactttagagggttatcgcaagtgtttcaaacactccaaatcttgttagtttctcattattcgcatcgcatagattctgattcttcttttaagaggacactgatagacgttcatgttttcaatttcatcgccaagtttctgtttaatagaattttattgaagaagaaccaaaacgatccaaaatggcttcaaaacttttacgaccagggagatggcaaacatttatgtgataaagttgactacaagcgcttgtgttcgttgcattttacccttatttactctattattaacattcaactcatcaaaatcaagacaaaccaaacatttgaaccgcagatattaaaatacgtatctgttctgaaattaattgaacacatacttatcatcatcgaaagtctgatacatgtacttattagatttgtatcgaagcataaactaatatgcatcaaccggaaaaaggcgtactgtcgagtatacctcgaaagagaattgagtttgaagaaaacctacttaaagaacttttacagtgtaataagcggtgtcccagaaaaagagttagggggtctattgaaaatactcaagatagttattctatcattgctcgagacatttgaaagcattgaatggcagcacttaaaacctttcctggaaaaatttccggctcatgaaatatcgcttcagaagaaaaggaaatatatacaggcggccttattaattactgccgaaagaaatttgatagcgcgctttcgattgtcaagatggttcaatgagacagaaaacatttaa

SEQ ID NO: 616 - DNA, 1956 bp, Saccharomyces cerevisiae
atgagcgaatcggaagccaaatctaggtcggctacaccgccaagtaaagctaaacaagctactccaacaactacagctgcagctaatggagaaaagaaattaacaaacaaggagctaaaagaactaaagaaacaagaaaaagctgcaaagagagctgcaatgaagcaggctaatggtatatccattgaacaacagcaacaacaagcacaaatgaaaaaagagaagaaacaactacaacgtgagcaacaacagaaaagagagcaaaagcaaaaaaatgccaataaaaaaaaacaaaatgaacgaaacgtgaaaaagagcacactttttggtcatctggaaactactgaagaaagaagagcgacaattttagctttaaccagtgcagtatcatctccaaaaacttcgcgaatcaccgctgctgggttgatggtccccgtggtggctagtgcattatcaggatctaacgtattaacggcttcttccttgatgcccgtgggtccaaacgcgtcgtctactgtatctgcatcagctccagcttcaacaacaacgactcttcctgcctcttctgcagcactctctgccggtaccagttctgcgtcaacaaatactccaacagctatacaacaagagattgcttcatcaaacgcttctgatgttgccaagacattggcatctatctcgttagaggctggtgagtttaatgtcattcccggtatatcgtcagtgatccctaccgtgttagaacaatcatttgacaactccagcttgatatcgtctgttaaggaacttttattgaataaagaccttatccatccgtcgatattattattaacttctcatctagcacactataaaatcgtgggatccatcccacgttgcatagccatgctagaggttttccaaattgttatcaaagactatcaaacacctaagggaactaccttgtcacgtaacttaacaagttatttgtcacaccagattgatcttttgaaaaaagctagacctttaagtgttactatgggtaatgctatcagatggttaaagcaagaaatttcattaattgacccatctacccccgacaaagccgccaaaaaagacctttgtgagaaaattgggcagtttgctaaagaaaaaatcgaactggctgatcaactaattatagacaatgcctctacacaaattgaagaatctactactattgtgacatatggttcatcaaaggttctaactgaactgttactgcataatgcaatcagtttaaagaaaaacatcaaagtgattgtcgtcgattcgagaccactatttgaagggcggaaaatggcagaaactttaagaaatgctggtgtcaatgttatgtatgcacttattacaagtttggatacgatattcaatatggatgtggactatgtgtttttaggagcccattctatcctatctaatgggttcctatattcaagagctgggacagcaatgttggctatgagcgctaagagaagaaatatacctgtattagtctgctgcgaaagtttgaagttttcacaaagagtacaattggatagtgtcacatttaatgaactggcagatccaaatgacctggttaatatagattacgaaaatccagtcgagagacgcggtaataaaggtgcgttattaaaccaatttatcaaagaaagaaaatttgaaaagaaaaagctagcaatggagaataagccaaagggtaataaaattggcggtaagaaaggatctgaaggagaaagcaaggacgccagtaatgaagaagacagcaacagcaaaaatattttggatggttggcaagagttaccttcgttaaatattgtcaacatcttatacgatttaacaccaccagaatatattaaaaaagtgatcactgaattcggcgctttgccaccttcatctgtccctgttattttaagagagtacaaaggttccgcataa

SEQ ID NO: 617 - DNA, 342 bp, Saccharomyces cerevisiae
atggtattgaggcgacataagttgttagcacagcaaagatggttgcgggttaagttttctgatcgttctgggagagtatttacgttaaaaaataggaatcaattaagcataatcatgccgttttgtgtgctacatatctgtttcccactatataaagtcacgttagaatgcaatttatctaatttactaccccattttagcgtcagtggattggtaaatccctttgctagcaaggtactgtcagaatatttctccttcctttcaaataattgcaccaatatcttgccaatacttcacttgagattgttctacaatatccgctgtcttggaaagcaattttga

SEQ ID NO: 618 - DNA, 363 bp, Saccharomyces cerevisiae
atggacatcagcattcaatgtatatcttatcacaccagtttatccaaagatagatgcagttttgaaattggttacttagaatatttctactacatttcgataacaaatataactattttgaatttaaaagttgagtatccaaaaattttagaaatacatacaattacttcccaattacttcccaaatattctcccccctggtttgatatcataaaagcaccttatggcaacaagattcccgggatagtaatgctatttaaatgtatatctatttctcgaatacttgtatctttactccactacccctatgcaagaagatacgcgatagtttttgttccttcctcttcctactctgttaattaa

SEQ ID NO: 619 - DNA, 462 bp, Saccharomyces cerevisiae
atgtccctacggccttgtctaacaccatccagcatgcaatacagtgacatatatatacacacaccacacccacacccacacccacacccacacacacccacacacacacacccacacacacccacacccacaccacacccacacccacacacaccacacccacacaccacacccacacccacaccacaccacacccacacaccacacaccaccctatctaacctgtctcttaacctaccctcacattaccctacctccccactcgttaccctgccccactcaaccataccactcccaaccaccatccatctctctacttactactaccatccaccgcccatcataaccgttaccctccaattacccatatccaactccactaccattaccctgctattaccctaccatccaccatgtcctactcactgtactgttgttctaccctccatattgaaacgttaa

SEQ ID NO: 620 - DNA, 1764 bp, Saccharomyces cerevisiae
atggacaagtatttgaattcatttgttgaccacctttcagagtggtcatctcgtgcctttaggaacaattcatcaagcgctaaccaaagtgcgtcgaacaaggaattagaacaagtttttgaacagatcaatgctatagttgaaaaccacaataacaaattaaccactgcctttgataagatatcatatcgcgttgctcacaagattacacacttggtggaaagccattctttagtattcaactacgccactttagttctcatcgcaagtgctttggtcgttattggctcatttacgtctatttcttctattccatttacagctctacctcctacgagagaacactcattgtttgatcctacagattttgatgtggaccacgactgtcatgttatctaccgcgagaatgacgaagataaaaagaaaaagaagaaaagcaagaggtttttcgatatgatggatgaaaaacatgcgattatactgcccttaactagtggctgtactttactcgctctctattttgtgatcaagaaactacacctaaactggctaaaatatgtggtgaaaattttgaattttaatataacactgctaaatatcccagctggcacatttgtctactcctactttctcaactcacttttcagaaacctatcacatttagcttcttggaatcccctggttgttttaccaaggtatcgtgtaacaatagctgatgataacgaagacctgaacaagataggcgggtttgttaccaatttgaattacaaagatggattgaccaactcagttgttcacaagaaaacattggatgagattgaaaaagatcattggatgaagcatttttacagaagagaattagttgaaccgaaggatattaaatcgaagaggcagatcagcaacatgtatttgaatagcgcattaattgtttcgttcgttctgtccatcgtttctaccgtatatttctatttatcacccaatgattggttaatatccaatgctgtcagtatgaatatggctatttggtccattgctcaattaaaattgaagaatttaaaatcaggggccctaatcctaattgctctatttttttacgacatttgctttgtctttggtaccgatgtaatggttacagtagctactaaccttgatattcccgtaaaactaagcttaccagtcaagtttaatacagctcaaaacaacttcaatttttcaatacttggtctgggtgatattgccttgcctggtatgtttattgcgatgtgctacaaatatgacatctggaagtggcaccttgatcatgatgacactgaattccactttttgaactggtcatacgttggaaaatattttattactgctatggttagttacgttgcttctttggtatctgccatggtctccttgtccattttcaatactgctcaaccggctttattatacattgttccttccttgttgattagtactattttggtagcttgctggaacaaggattttaagcagttttggaattttcagtatgatacgattgaagtggataaaagtttaaaaaaagcgatagaaaaaaaggagaactctataacttattcgaccttcatcctatcagaatactataatgatgccgacaagtatgccttgcttggtgatgatgtaaacgaaaattttgacgatgatgaagaattcgtgcaagaggaagatctcagtgacagctctgaggaagagctttctgaagaagatctcttggatgacgaatcttcttga

SEQ ID NO: 621 - DNA, 1929 bp, Saccharomyces cerevisiae
atggacaagaagaaggatctactggagaacgaacaatttctccgcatccaaaagctcaacgctgccgatgcgggcaaaagacaatctataacagtggacgacgagggcgaactatatgggttagacacctccggcaactcaccagccaatgaacacacagctaccacaattacacagaatcacagcgtggtggcctcaaacggagacgtcgcattcatcccaggaactgctaccgaaggcaatacagagattgtaactgaagaagtgattgagaccgatgataacatgttcaagacccatgtgaagactttaagctccaaagagaaggcacggtataggcaagggtcctctaactttatatcgtatttcgatgatatgtcatttgaacacaggcccagtatattagatgggtcagttaacgagcccttcaagaccaaattcgtgggacctactttagaaaaggagatcagaagaagggagaaagagctaatggccatgcgcaaaaatttacaccaccgcaagtcctccccagatgctgtcgactcagtagggaaaaatgatggcgccgccccaactactgttccaactgccgccacctcagaaacggtggtcaccgttgaaaccaccataatttcatccaatttctccgggttgtacgtggcgttttggatggctattgcatttggtgctgtcaaggctttaatagactattattaccagcataatggtagcttcaaggattcggagatcttgaaatttatgactacgaatttgttcactgtggcatccgtagatcttttgatgtatttgagcacttattttgtcgttggaatacaatacttatgcaagtggggggtcttgaaatggggcactaccggctggatcttcacctcaatttacgagtttttgtttgttatcttctacatgtatttaacagaaaacatcctaaaactacactggctgtccaagatcttcctttttttgcattctttagttttattgatgaaaatgcattctttcgccttctacaatggctatctatggggtataaaggaagaactacaattttccaaaagcgctcttgccaaatacaaggattctataaatgatccaaaagttattggtgctcttgagaaaagctgtgagttttgtagttttgaattgagctctcagtctttaagcgaccaaactcaaaaattccccaacaatatcagtgcaaaaagctttttttggttcaccatgtttccaaccctaatttaccaaattgaatatccaagaactaaggaaatcagatggagctacgtattagaaaagatctgcgccatcttcggtaccattttcttaatgatgatagatgctcaaatcttgatgtatcctgtagcaatgagagcattggctgtgcgcaattctgaatggactggtatattggatagattattgaaatgggttggattgctcgttgatatcgtcccagggtttatcgtgatgtacatcttggacttctatttgatttgggatgccattttgaactgtgtggctgaattgacaagatttggcgacagatatttctacggtgactggtggaattgtgttagttgggcagacttcagtagaatttggaacatcccagtgcataagtttttgttaagacatgtttaccatagttcaatgagttcattcaaattgaacaagagtcaagcaactttgatgacctttttcttaagttccgtcgttcatgaattagcaatgtacgttatcttcaagaaattgaggttttacttgttcttcttccaaatgctgcaaatgccattagtagctttaacaaatactaaattcatgaggaacagaaccataatcggaaatgttattttctggctcggtatctgcatgggaccaagtgtcatgtgtacgttgtacttgacattctaa

SEQ ID NO: 622 - protein, 358 aa, Glycine max
MTMLQKMAELMEYSYLLDMADKTEDPYMRLVYASSFFISVYYAYQRTWKPFNPILGETYEMVNHGGITFISEQVSHHPPMSAGHAETEHFTYDVTSKLKTKFLGNSVDVYPVGRTRVTLKRDGVVLDLVPPPTKVSNLIFGRTWIDSPGEMILTNLTTGDKVVLYFQPCGWFGYEVDGYVYNSADEPKILMTGKWNEAMNYQVCDSEGEPLPGTELKEIWRVADTPKKDKFQYTHFAHKINSFDTAPKKLLASDSRLRPDRMALEKGDLSTSGYEKSSLEERQRAEKRNREAKGHKFTPRWFDLTDEVTPTPWGDLEVYQYNGKYTQHCAAVDSSECIEVPDIRPEFNPWQYDNLDAE

SEQ ID NO: 623 - protein, 300 aa, Glycine max
MCNNGQSPLDRFISVVAWCISTTRPVTFGVAPYNPILGETHHVSRGNLNVLLEQISHHPPVTALHATDEKENIEMLWCQRPDPKFNGTSVEAKVHGIRQLKLLNHGETYEMNCPRLLLRILPVPGADWAGTVNIRCLETGLVAELSYRSSSFLGIGGNHRVIKGKILDSSSLKVLYEVDGHWDRTVKVKDTNNGKVRVIYDAKEVMSGLETPILKDIEGVWQTESAHVWGELNQAIVSKDWEKAREAKLKVEERQRELVRERESKGETWISKHFVVSNNKEGWQCSPIHKSVPAAPITAL

SEQ ID NO: 624 - protein, 355 aa, Glycine max
MAELMEYSYLLDMADKTEDPYMRLVYASSFFISVYYAYQRTWKPFNPILGETYEMVNHGGITFISEQVSHHPPMSAGHAETEHFTYDVTSKLKTKFLGNSVDVYPVGRTRVTLKRDGVVLDLVPPPTKVSNLIFGRTWIDSPGEMILTNLTTGDKVVLYFQPCGWFGAGRYEVDGYVYNSADEPKILMTGKWNEAMNYQVCDSEGEPLPGTELKEIWRVADTPKKDKFQYTHFAHKINSFDTAPKKLLASDSRLRPDRMALEKGDLSTSGYEKSSLEERQRAEKRNREAKGHKFTPRWFDLTDEVTPTPWGDLEVYQYNGKYTQHCAAVDSSECIEVPDIRPEFNPWQYDNLDAE

SEQ ID NO: 625 - protein, 414 aa, Zea mays
MATKEEASAVPAASKTSWSSFLKSIASFNGDLSSLTAPPFILSTTSLTEYSAYWCEHPALFVAPAREPDPAKRALLVLKWFLSTLHQQYCSRSEKLGSEKKPLNPFLGELFLGKWIEDEDVGETRLISEQVSHHPPATAYSIVNEKHGVELQGYNAQKASFSSTIQVKQLGHAYLSLTPPGKDANNEDDREHYLITLPNLHIESLIYGTPFVELEKSCKIASSTGYISKIDFSGKGWLSGKKNTFSAVLYKESDGEKNPLYTADGQWSSSFTIRDARAKKDIETFTISNLKTTPLTVAPLDEQDEWETRRAWRDVAAAIERGDMEATSNAKTKIEVAQRELRKKEKEQGEEWERRFFKRVNEKDEPTFMRLAAMLDLTQGIESDRTGGVWRFDPSRAVDANPPYHKVGGEGLGL

SEQ ID NO: 626 - protein, 434 aa, Saccharomyces cerevisiae
MSQHASSSSWTSFLKSISSFNGDLSSLSAPPFILSPTSLTEFSQYWAEHPALFLEPSLIDGENYKDHCPFDPNVESKEVAQMLAVVRWFISTLRSQYCSRSESMGSEKKPLNPFLGEVFVGKWKNDEHPEFGETVLLSEQVSHHPPMTAFSIFNEKNDVSVQGYNQIKTGFTKTLTLTVKPYGHVILKIKDETYLITTPPLHIEGILVASPFVELGGRSFIQSSNGMLCVIEFSGRGYFTGKKNSFKARIYRSPQEHSHKENALYLISGQWSGVSTIIKKDSQVSHQFYDSSETPTEHLLVKPIEEQHPLESRRAWKDVAEAIRQGNISMIKKTKEELENKQRALREQERVKGVEWQRRWFKQVDYMNENTSNDVEKASEDDAFRKLASKLQLSVKNVPSGTLIGGKDDKKDVSTALHWRFDKNLWMRENEITI

We claim:

1. An isolated nucleic acid molecule that encodes a protein comprising the amino acid sequence of SEQ ID NO: 622.

2. The isolated nucleic acid molecule of claim 1, wherein the nucleic acid molecule comprises the nucleic acid sequence of SEQ ID NO: 1.

* * * * *